United States Patent
Kincaid et al.

(10) Patent No.: US 12,241,839 B2
(45) Date of Patent: Mar. 4, 2025

(54) MULTIPARTITE LUCIFERASE PEPTIDES AND POLYPEPTIDES

(71) Applicant: Promega Corporation, Madison, WI (US)

(72) Inventors: Virginia Kincaid, Madison, WI (US); Lance P. Encell, Madison, WI (US); Mary Hall, Madison, WI (US); Michael Killoran, Madison, WI (US); Keith Wood, Madison, WI (US); Melanie Dart, Madison, WI (US); Trish Hoang, Madison, WI (US)

(73) Assignee: Promega Corporation, Madison, WI (US)

(*) Notice: Subject to any disclaimer, the term of this patent is extended or adjusted under 35 U.S.C. 154(b) by 712 days.

(21) Appl. No.: 17/105,925

(22) Filed: Nov. 27, 2020

(65) Prior Publication Data

US 2021/0262941 A1    Aug. 26, 2021

Related U.S. Application Data

(60) Provisional application No. 62/941,255, filed on Nov. 27, 2019.

(51) Int. Cl.
*G01N 21/76* (2006.01)
*C12N 9/02* (2006.01)
*G01N 33/58* (2006.01)

(52) U.S. Cl.
CPC ......... *G01N 21/763* (2013.01); *C12N 9/0069* (2013.01); *G01N 33/582* (2013.01)

(58) Field of Classification Search
CPC ... G01N 21/763; G01N 33/582; C12N 9/0069
See application file for complete search history.

(56) References Cited

U.S. PATENT DOCUMENTS

| | | | |
|---|---|---|---|
| 4,946,778 | A | 8/1990 | Ladner et al. |
| 5,260,203 | A | 11/1993 | Ladner et al. |
| 8,669,103 | B2 | 3/2014 | Binkowski et al. |
| 8,697,359 | B1 | 4/2014 | Zhang |
| 9,487,520 | B2 | 11/2016 | Klaubert et al. |

(Continued)

FOREIGN PATENT DOCUMENTS

| | | |
|---|---|---|
| WO | WO 1988/01649 | 3/1988 |
| WO | WO 1993/06868 | 4/1993 |

(Continued)

OTHER PUBLICATIONS

Lisette G.G.C. Verhoef, Michela Mattioli, Fernanda Ricci, Yao-Cheng Li, Mark Wade, Multiplex detection of protein-protein interactions using a next generation luciferase reporter, 2016, Biochimica et Biophysica Acta, vol. 1863, 284-292 (Year: 2016).*

(Continued)

*Primary Examiner* — David W Berke-Schlessel
*Assistant Examiner* — Trent R Clarke
(74) *Attorney, Agent, or Firm* — David W. Staple; Casimir Jones, S.C.

(57) ABSTRACT

Provided herein are bioluminescent polypeptides and compositions and methods for the assembly of a tripartite or multipartite bioluminescent complex. In particular embodiments, a bioluminescent complex is formed upon the interaction of three or more peptide and/or polypeptide components.

18 Claims, 259 Drawing Sheets

Specification includes a Sequence Listing.

(56) References Cited

U.S. PATENT DOCUMENTS

| | | | |
|---|---|---|---|
| 9,797,889 | B2 | 10/2017 | Dixon et al. |
| 9,797,890 | B2 | 10/2017 | Dixon et al. |
| 9,908,918 | B2 | 3/2018 | Lin et al. |
| 2008/0248511 | A1 | 10/2008 | Daily et al. |
| 2010/0281552 | A1 | 11/2010 | Encell et al. |
| 2012/0107849 | A1 | 5/2012 | Klaubert et al. |
| 2012/0174242 | A1 | 7/2012 | Binkowski et al. |
| 2013/0317207 | A1 | 11/2013 | Kirkland et al. |
| 2014/0068797 | A1 | 3/2014 | Doudna et al. |
| 2014/0099654 | A1 | 4/2014 | Cali et al. |
| 2015/0152395 | A1 | 6/2015 | Branchini |
| 2016/0282360 | A1 | 9/2016 | Dart et al. |
| 2017/0233789 | A1 | 8/2017 | Shakhmin et al. |
| 2018/0030059 | A1 | 2/2018 | Hall et al. |
| 2018/0172692 | A1 | 6/2018 | Dixon et al. |
| 2019/0352623 | A1 | 11/2019 | Dixon et al. |
| 2019/0383808 | A1* | 12/2019 | Javitch ............... C12N 9/12 |

FOREIGN PATENT DOCUMENTS

| | | |
|---|---|---|
| WO | WO 1994/08629 | 4/1994 |
| WO | WO 1994/09056 | 4/1994 |
| WO | WO 1996/26754 | 9/1996 |
| WO | WO 2003/040100 | 5/2003 |
| WO | WO 2012/061529 | 5/2012 |
| WO | WO 2013/177255 | 11/2013 |
| WO | WO 2016/127100 | 8/2016 |
| WO | WO 2017/189751 | 11/2017 |
| WO | WO 2019/164402 | 8/2019 |
| WO | WO 2019/241438 | 12/2019 |
| WO | WO 2020/210658 | 10/2020 |

OTHER PUBLICATIONS

Barrangou et al., CRISPR provides acquired resistance against viruses in prokaryotes. Science. Mar. 23, 2007;315(5819):1709-12.

Bhaya et al., CRISPR-Cas systems in bacteria and archaea: versatile small RNAs for adaptive defense and regulation. Annu Rev Genet. 2011;45:273-97.

Bolotin et al., Clustered regularly interspaced short palindrome repeats (CRISPRs) have spacers of extrachromosomal origin. Microbiology (Reading). Aug. 2005;151(Pt 8):2551-2561.

Boutureira et al., Advances in chemical protein modification. Chem Rev. Mar. 11, 2015;115(5):2174-95.

Brouns et al., Small CRISPR RNAs guide antiviral defense in prokaryotes. Science. Aug. 15, 2008;321(5891):960-4.

Cong et al., Multiplex genome engineering using CRISPR/Cas systems. Science. Feb. 15, 2013;339(6121):819-23.

Deltcheva et al., CRISPR RNA maturation by trans-encoded small RNA and host factor RNase III. Nature. Mar. 31, 2011;471(7340):602-7.

Deveau et al., CRISPR/Cas system and its role in phage-bacteria interactions. Annu Rev Microbiol. 2010;64:475-93.

Garneau et al., The CRISPR/Cas bacterial immune system cleaves bacteriophage and plasmid DNA. Nature. Nov. 4, 2010;468(7320):67-71.

Gasiunas et al, Cas9-crRNA ribonucleoprotein complex mediates specific DNA cleavage for adaptive immunity in bacteria. Proc Natl Acad Sci U S A. Sep. 25, 2012;109(39):E2579-86.

Hale et al., RNA-guided RNA cleavage by a CRISPR RNA-Cas protein complex. Cell. Nov. 25, 2009;139(5):945-56.

Horvath et al., CRISPR/Cas, the immune system of bacteria and archaea. Science. Jan. 8, 2010;327(5962):167-70.

Huang et al., Production of Gene-Corrected Adult Beta Globin Protein in Human Erythrocytes Differentiated from Patient iPSCs After Genome Editing of the Sickle Point Mutation. Stem Cells. May 2015;33(5):1470-9.

Hudson et al., Engineered antibodies. Nat Med. Jan. 2003;9(1):129-34.

Inagaki et al., Genetically encoded bioluminescent voltage indicator for multi-purpose use in wide range of bioimaging. Sci Rep. Feb. 13, 2017;7:42398.

Isidro-Llobet et al., Amino acid-protecting groups. Chem Rev. Jun. 2009;109(6):2455-504.

Jinek et al., A programmable dual-RNA-guided DNA endonuclease in adaptive bacterial immunity. Science. Aug. 17, 2012;337(6096):816-21.

Koniev et al., Developments and recent advancements in the field of endogenous amino acid selective bond forming reactions for bioconjugation. Chem Soc Rev. Aug. 7, 2015;44(15):5495-551.

Makarova et al., A putative RNA-interference-based immune system in prokaryotes: computational analysis of the predicted enzymatic machinery, functional analogies with eukaryotic RNAi, and hypothetical mechanisms of action. Biol Direct. Mar. 16, 2006;1:7. 26 pages.

Makarova et al., Evolution and classification of the CRISPR-Cas systems. Nat Rev Microbiol. Jun. 2011;9(6):467-77.

Mali et al., RNA-guided human genome engineering via Cas9. Science. Feb. 15, 2013;339(6121):823-6.

Marraffini et al., CRISPR interference limits horizontal gene transfer in *staphylococci* by targeting DNA. Science. Dec. 19, 2008;322(5909):1843-5.

Mojica et al., Intervening sequences of regularly spaced prokaryotic repeats derive from foreign genetic elements. J Mol Evol. Feb. 2005;60(2):174-82.

Patterson et al., Finding the right (bioorthogonal) chemistry. ACS Chem Biol. Mar. 21, 2014;9(3):592-605.

Pourcel et al., CRISPR elements in Yersinia pestis acquire new repeats by preferential uptake of bacteriophage DNA, and provide additional tools for evolutionary studies. Microbiology (Reading). Mar. 2005;151(Pt 3):653-663.

Sapranauskas et al., The *Streptococcus thermophilus* CRISPR/Cas system provides immunity in *Escherichia coli*. Nucleic Acids Res. Nov. 2011;39(21):9275-82.

Schaub et al., Fluorophore-NanoLuc® BRET Reporters Enable Sensitive In Vivo Optical Imaging and Flow Cytometry for Monitoring Tumorigenesis. Cancer Res. Dec. 1, 2015;75(23):5023-33.

Smith et al., Efficient and allele-specific genome editing of disease loci in human iPSCs. Mol Ther. Mar. 2015;23(3):570-7.

Suzuki et al., Five colour variants of bright luminescent protein for real-time multicolour bioimaging. Nat Commun. Dec. 14, 2016;7:13718.

Tomalia et al., Starburst Dendrimers: Molecular-Level Control of Size, Shape, Surface Chemistry, Topology, and Flexibility from Atoms to Macroscopic Matter. Angew. Chem. Int. Ed. Engl. 1990;29:138-175.

Xiao-Jie et al., CRISPR-Cas9: a new and promising player in gene therapy. J Med Genet. May 2015;52(5):289-96.

Xie et al., Seamless gene correction of β-thalassemia mutations in patient-specific iPSCs using CRISPR/Cas9 and piggyBac. Genome Res. Sep. 2014;24(9):1526-33.

International Search Report and Written Opinion, for PCT/US2020/062499, mailed May 19, 2021, 35 pgs.

Office Action for Chinese Application No. 202080095195.6, mailed Jan. 9, 2024 (9 pages).

\* cited by examiner

ATG 3121=3092+N105S
ATG 3440=3092+V102D+E115D
ATG 3092=Q42M+E4E+M106K)
ATG 2098=W.T. LgTrip Titration of β9 peptide in the presence of constant β10 and polypeptide Titration of β10 peptide in the presence of constant β9 and polypeptide

| ATG# | LgTrip | SmTrip 9 | Pep Sequence | SEQ ID NO. |
|---|---|---|---|---|
| 3546 | LgTrip | 286 | SSWKRGSMLFRVTINS | 37 |
| 3722 | LgTrip + GSM | 380 | SSWKRLFRVTINS | 180 |
| 3723 | LgTrip + GSML | 383 | SSWKRFRVTINS | 181 |
| 3724 | LgTrip + GSMLF | 386 | SSWKRRVTINS | 182 |
| 3725 | LgTrip – TPD | 389 | SSWKRTPDGSMLFRVTINS | 183 |
| 3726 | LgTrip – ITPD | 392 | SSWKRITPDGSMLFRVTINS | 184 |
| 3727 | LgTrip - LITPD | 395 | SSWKRLITPDGSMLFRVTINS | 185 |

| ATG# | LgTrip |
|------|--------|
| 3546 | LgTrip |
| 3722 | LgTrip + GSM |
| 3723 | LgTrip + GSML |
| 3724 | LgTrip + GSMLF |
| 3725 | LgTrip – TPD |
| 3726 | LgTrip – ITPD |
| 3727 | LgTrip - LITPD |

| SmTrip 9 | Pep Sequence | SEQ ID NO. |
|---|---|---|
| 286 | SSWKRGSMLFRVTINS | 37 |
| 380 | SSWKRLFRVTINS | 180 |
| 383 | SSWKRFRVTINS | 181 |
| 386 | SSWKRRVTINS | 182 |
| 389 | SSWKRTPDGSMLFRVTINS | 183 |
| 392 | SSWKRITPDGSMLFRVTINS | 184 |
| 395 | SSWKRLITPDGSMLFRVTINS | 185 |

FIG. 36

| Pep ID | Pep Sequence | SEQ ID NO. | SmTrip9 Kd (uM) | Bmax (RLU) |
|---|---|---|---|---|
| \multicolumn{5}{|l|}{SmTrip9 Titrations with 0.05 nM LgTrip and 25 uM HiBiT} |
| 286 | SSWKRGSMLFRVTINS | 37 | 0.09 | 1.65E7 |
| 292 | SSWKRMLFRVTINS | 153 | 0.10 | 1.65E7 |
| 305 | SSWKRGSMLFRVTIN | 164 | 0.60 | 1.16E7 |
| 306 | SSWKRGSMLFRVTI | 165 | 0.17 | 1.77E7 |
| 307 | SSWKRSMLFRVTIN | 166 | 0.10 | 1.47E7 |
| 308 | SSWKRMLFRVTIN | 167 | 0.11 | 1.55E7 |
| 312 | SSWKRMLFRVTI | 171 | 0.05 | 1.77E7 |

FIG. 37

| HiBiT Titrations with 0.05 nM LgTrip and 5 uM SmTrip9 pep286 | | | | |
|---|---|---|---|---|
| Pep ID | Pep Sequence | SEQ ID NO. | SmTrip9 Kd (uM) | Bmax (RLU) |
| 286 | SSWKRGSMLFRVTINS | 37 | 0.47 | 1.75E7 |
| 292 | SSWKRMLFRVTINS | 153 | 0.47 | 1.69E7 |
| 305 | SSWKRGSMLFRVTIN | 164 | 3.81 | 1.55E7 |
| 306 | SSWKRGSMLFRVTI | 165 | 0.66 | 1.86E7 |
| 307 | SSWKRSMLFRVTIN | 166 | 1.22 | 1.42E7 |
| 308 | SSWKRMLFRVTIN | 167 | 0.60 | 1.59E7 |
| 312 | SSWKRMLFRVTI | 171 | 0.25 | 1.79E7 |

FIG. 38

SmTrip9 Titrations with 0.1 nM LgTrip and 25 uM HiBiT

| SEQ ID NO: | Pep ID | Sequence | SmTrip9 Kd (uM) | Bmax (RLU) |
|---|---|---|---|---|
| 37 | 286 | SSWKRGSMLFRVTINS | 0.19 | 3.45E7 |
| 190 | 401 | SSWKRGSMLYRVTINS | 0.16 | 1.69E6 |
| 191 | 402 | SSWKRGSMLWRVTINS | 0.02 | 2.29E5 |
| 192 | 403 | SSWKRGSMLHRVTINS | 0.07 | 1.01E6 |
| 193 | 404 | SSWKRGSLLFRVTINS | 0.18 | 3.41E7 |
| 194 | 405 | SSWKRGSKLFRVTINS | 33.07 | 7.12E6 |
| 195 | 406 | SSWKRGSRLFRVTINS | 9.23 | 2.65E6 |
| 196 | 407 | SSWKRGSFLFRVTINS | 0.65 | 1.51E7 |
| 197 | 408 | SSWKRGSWLFRVTINS | 3.93 | 4.64E6 |
| 198 | 409 | SSWKRGSMLFRVSINS | 0.47 | 3.48E7 |
| 199 | 410 | SSWKRGSMLFRVQINS | 0.46 | 2.58E7 |
| 200 | 411 | SSWKRGSMLFRVNINS | 1.69 | 2.99E7 |

FIG. 39

SmTrip9 Titrations with 0.1 nM LgTrip and 25 uM HiBiT

| SEQ ID NO: | Pep ID | Sequence | SmTrip9 Kd (uM) | Bmax (RLU) |
|---|---|---|---|---|
| 37 | 286 | SSWKRGSMLFRVTINS | 0.19 | 3.45E7 |
| 153 | 292 | SSWKRMLFRVTINS | 0.21 | 2.93E7 |
| 157 | 297 | SSWKRMLFRVTINSV | 0.2 | 2.06E7 |
| 160 | 302 | SSWKRMLFRVTINSVS | 0.52 | 1.27E7 |
| 186 | 396 | SSWKRMLFRVTINSWK | 0.66 | 2.89E7 |
| 187 | 397 | SKRGSMLFRVTINSWS | 0.37 | 2.80E7 |
| 188 | 398 | SWRGSMLFRVTINS | 1.28 | 2.33E7 |
| 297 | 399 | SSKRGSMLFRVTIWS | 0.12 | 4.02E7 |
| 189 | 400 | SSRGSMLFRVTIWK | 0.07 | 4.06E7 |

FIG. 40

| SEQ ID NO: | Pep ID | Sequence | SmTrip9 Kd in uM (Bmax in RLU) | HiBiT Kd in uM (Bmax in RLU) |
|---|---|---|---|---|
| 37 | 286 | SSWKRGSMLFRVTINS | 0.19 (3.45E7) | 0.73 (3.66E7) |
| 153 | 292 | SSWKRMLFRVTINS | 0.21 (2.93E7) | 1.55 (3.05E7) |
| 157 | 297 | SSWKRMLFRVTINSV | 0.2 (2.06E7) | 5.09 (1.36E7) |
| 160 | 302 | SSWKRMLFRVTINSVS | 0.52 (1.27E7) | 8.15 (1.75E7) |

SmTrip9 or HiBiT Titrations with 0.1 nM LgTrip

| ATG# | Detail |
|---|---|
| 1634 | FRB-15GS-AI-86 |
| 3586 | FRB-15GS-AI-289 |
| 3743 | FRB-15GS-AI-86-His6 |
| 3744 | FRB-15GS-AI-289-His6 |
| 3760 | His6-FRB-5GS-86 |
| 3761 | His6-FRB-10GS-86 |
| 3762 | His6-FRB-15GS-86 |
| 3763 | His6-FRB-5GS-289 |
| 3764 | His6-FRB-10GS-289 |
| 3765 | His6-FRB-15GS-289 |

| Pep ID | SEQ ID NO. | Sequence |
|--------|------------|----------|
| 245 | 23 | GSMLFRVTINS |
| 292.x | 289 | MLFRVTINS |
| 297.x | 290 | MLFRVTINSV |
| 302.x | 291 | MLFRVTINSVS |
| 305.x | 292 | GSMLFRVTIN |
| 306.x | 293 | GSMLFRVTI |
| 307.x | 294 | SMLFRVTIN |
| 308.x | 295 | MLFRVTIN |
| 312.x | 296 | MLFRVTI |

| Pep ID | SEQ ID NO. | Sequence |
|--------|------------|----------|
| 245    | 23         | GSMLFRVTINS |
| 292.x  | 289        | MLFRVTINS |
| 297.x  | 290        | MLFRVTINSV |
| 302.x  | 291        | MLFRVTINSVS |
| 305.x  | 292        | GSMLFRVTIN |
| 306.x  | 293        | GSMLFRVTI |
| 307.x  | 294        | SMLFRVTIN |
| 308.x  | 295        | MLFRVTIN |
| 312.x  | 296        | MLFRVTI |

| Pep ID | SEQ ID NO. | Sequence |
|---|---|---|
| 89 | 824 | VSGWRLFKKIS |
| 289 | 826 | VSVSGWRLFKKIS |
| 245 | 23 | GSMLFRVTINS |
| 292.x | 289 | MLFRVTINS |
| 297.x | 290 | MLFRVTINSV |
| 302.x | 291 | MLFRVTINSVS |

| Pep ID | SEQ ID NO. | Sequence |
|---|---|---|
| 89 | 824 | VSGWRLFKKIS |
| 289 | 826 | VSVSGWRLFKKIS |
| 245 | 23 | GSMLFRVTINS |
| 292.x | 289 | MLFRVTINS |
| 297.x | 290 | MLFRVTINSV |
| 302.x | 291 | MLFRVTINSVS |

| Pep ID | SEQ ID NO. | Sequence |
|---|---|---|
| 89 | 824 | VSGWRLFKKIS |
| 289 | 826 | VSVSGWRLFKKIS |
| 245 | 23 | GSMLFRVTINS |
| 292.x | 289 | MLFRVTINS |
| 297.x | 290 | MLFRVTINSV |
| 302.x | 291 | MLFRVTINSVS |

| Pep ID | SEQ ID NO. | Sequence |
|---|---|---|
| 245 | 23 | GSMLFRVTINS |
| 292.x | 289 | MLFRVTINS |
| 297.x | 290 | MLFRVTINSV |
| 302.x | 291 | MLFRVTINSVS |
| 305.x | 292 | GSMLFRVTIN |
| 306.x | 293 | GSMLFRVTI |
| 307.x | 294 | SMLFRVTIN |
| 308.x | 295 | MLFRVTIN |
| 312.x | 296 | MLFRVTI |

| Pep ID | SEQ ID NO. | Sequence |
|---|---|---|
| 245 | 23 | GSMLFRVTINS |
| 292.x | 289 | MLFRVTINS |
| 297.x | 290 | MLFRVTINSV |
| 302.x | 291 | MLFRVTINSVS |
| 305.x | 292 | GSMLFRVTIN |
| 306.x | 293 | GSMLFRVTI |
| 307.x | 294 | SMLFRVTIN |
| 308.x | 295 | MLFRVTIN |
| 312.x | 296 | MLFRVTI |

| Pep ID | SEQ ID NO. | Sequence |
|---|---|---|
| 245 | 23 | GSMLFRVTINS |
| 292.x | 289 | MLFRVTINS |
| 297.x | 290 | MLFRVTINSV |
| 302.x | 291 | MLFRVTINSVS |
| 305.x | 292 | GSMLFRVTIN |
| 306.x | 293 | GSMLFRVTI |
| 307.x | 294 | SMLFRVTIN |
| 308.x | 295 | MLFRVTIN |
| 312.x | 296 | MLFRVTI |

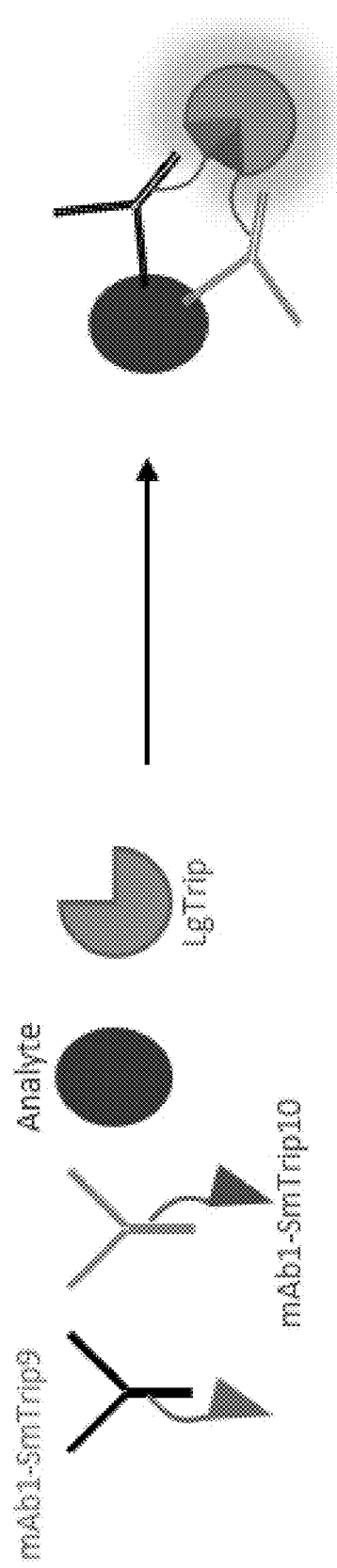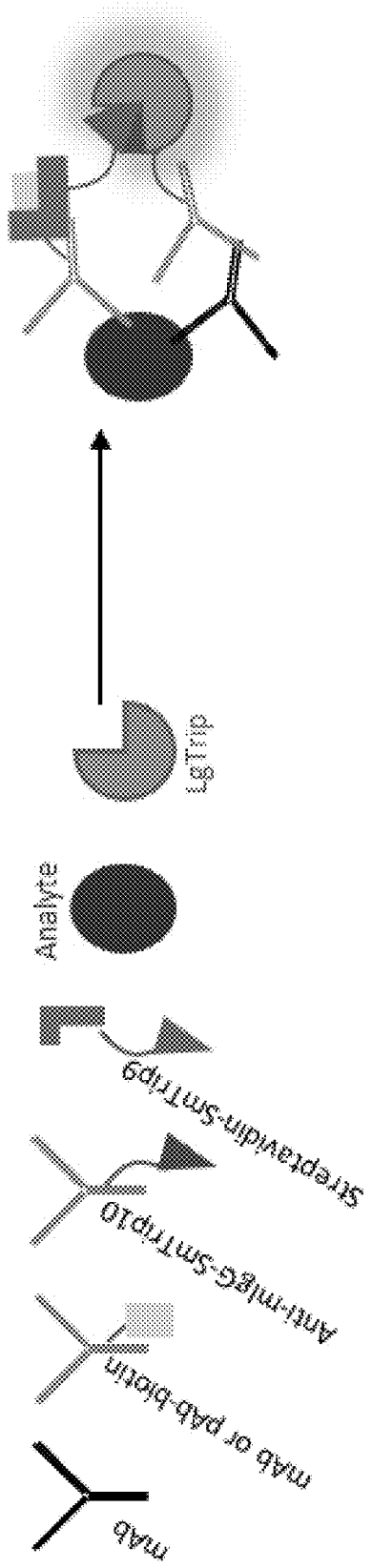

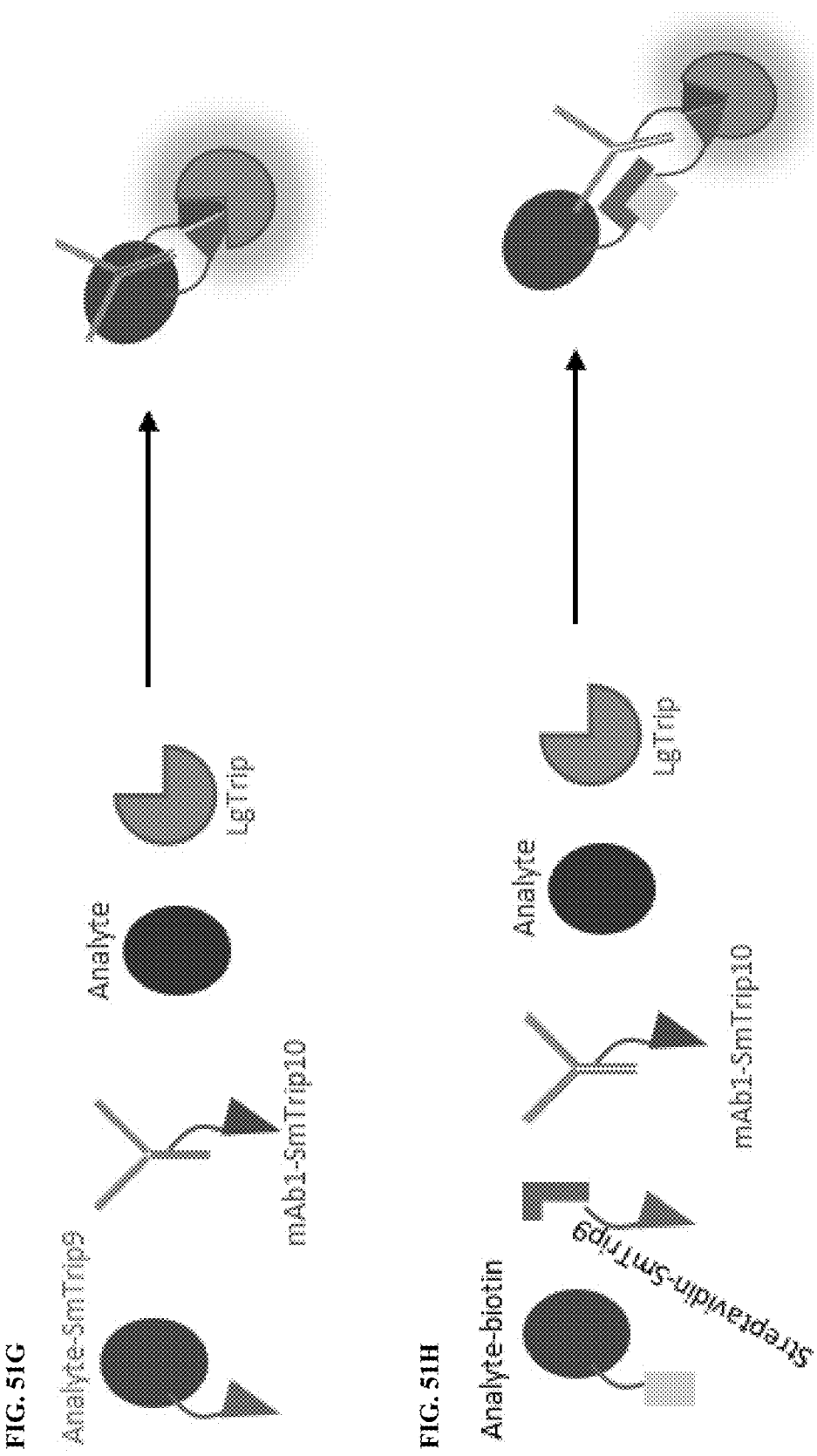
FIG. 51G Analyte-SmTrip9
FIG. 51H Analyte-biotin

| Pep ID | SEQ ID NO. | Sequence |
|--------|------------|----------|
| 245 | 23 | GSMLFRVTINS |
| 292.x | 289 | MLFRVTINS |
| 297.x | 290 | MLFRVTINSV |
| 302.x | 291 | MLFRVTINSVS |

| Pep ID | SEQ ID NO. | Sequence |
|---|---|---|
| 245 | 23 | GSMLFRVTINS |
| 295.x | 220 | GSMLFRVTINSV |
| 300.x | 221 | GSMLFRVTINSVS |
| 418.x | 226 | GSMLFRVTINSVSG |
| 419.x | 227 | GSMLFRVTINSVSGW |
| 422 | 228 | GSMLFRVTINSVSGWR |
| 423 | 229 | GSMLFRVTINSVSGWK |

| Pep ID | SEQ ID NO. | Sequence |
|---|---|---|
| 245 | 23 | GSMLFRVTINS |
| 295.x | 220 | GSMLFRVTINSV |
| 300.x | 221 | GSMLFRVTINSVS |
| 418.x | 226 | GSMLFRVTINSVSG |
| 419.x | 227 | GSMLFRVTINSVSGW |
| 422 | 228 | GSMLFRVTINSVSGWR |
| 423 | 229 | GSMLFRVTINSVSGWK |

FIG. 74

| | | Biochemical analysis of synthetic SmTrip9 variants | | |
|---|---|---|---|---|
| Pep ID | SEQ ID NO.: | Sequence | SmTrip9 Kd in uM (Bmax in RLU) | HiBiT Kd in uM (Bmax in RLU) |
| 286 | 37 | SSWKRGSMLFRVTINS | 0.10 (2.47E7) | 4.05 (2.76E7) |
| 416 | 225 | MLFRVTINSVSGWR | 3.54 (9.38E6) | 29.88 (1.13E7) |
| 417 | 224 | MLFRVTINSVSGWK | 1.15 (1.30E7) | 19.56 (1.68E7) |
| 422 | 228 | GSMLFRVTINSVSGWR | 0.24 (2.05E7) | 4.91 (2.48E7) |
| 423 | 229 | GSMLFRVTINSVSGWK | 0.18 (2.09E7) | 3.48 (2.52E7) |
| 434 | 230 | GSMLFRVTIWK | 0.03 (2.35E7) | 0.52 (2.38E7) |
| 435 | 231 | GSMLFRVTINSWK | 0.28 (2.27E7) | 6.11 (2.34E7) |

FIG. 75

| Biochemical analysis of synthetic SmTrip9 Variants ||||| 
|---|---|---|---|---|
| Pep ID | SEQ ID NO.: | Sequence | SmTrip9 (uM) | Bmax (RLU) |
| 286 | 37 | SSWKRGSMLFRVTINS | 0.10 | 2.47E7 |
| 412 | 246 | SSWKRMLFRVTINSVSG | 0.11 | 2.24E7 |
| 413 | 247 | SSWKRMLFRVTINSVSGW | 0.15 | 2.20E7 |
| 414 | 248 | SSWKRMLFRVTINSVSGWR | 0.16 | 2.27E7 |
| 415 | 249 | SSWKRMLFRVTINSVSGWK | 0.18 | 2.34E7 |
| 418 | 226 | GSMLFRVTINSVSG | 0.31 | 2.20E7 |
| 419 | 227 | GSMLFRVTINSVSGW | 0.33 | 2.03E7 |
| 420 | 251 | SSWKRGSMLFRVTINSVSG | 0.29 | 2.27E7 |
| 421 | 252 | SSWKRGSMLFRVTINSVSGW | 0.26 | 2.38E7 |
| 424 | 253 | SSWKRGSMLFRVTINSVSGWR | 3.33 | 4.03E6 |
| 425 | 254 | SSWKRGSMLFRVTINSVSGWK | 0.85 | 2.19E7 |
| 426 | 255 | SSWKRGSYLFRVTINS | 0.29 | 1.76E7 |
| 427 | 256 | SSWKRGSMLFRVKINS | 0.23 | 2.46E7 |
| 428 | 257 | SSWKRGSMLFRVRINS | 0.04 | 2.38E7 |
| 430 | 261 | SSWRGSMLFRVTIKS | 0.28 | 2.35E7 |
| 431 | 262 | KRSSGSMLFRVTIWS | 0.03 | 2.38E7 |
| 432 | 263 | SSKRMLFRVTIWS | 0.01 | 2.39E7 |
| 433 | 264 | KRSSMLFRVTIWS | 0.02 | 2.56E7 |
| 422 | 228 | GSMLFRVTINSVSGWR | 0.24 | 2.05E7 |
| 423 | 229 | GSMLFRVTINSVSGWK | 0.18 | 2.09E7 |
| 434 | 230 | GSMLFRVTIWK | 0.03 | 2.35E7 |
| 435 | 231 | GSMLFRVTINSWK | 0.28 | 2.27E7 |
| 492 | 313 | GSMLFRVTINKWK | 0.71 | 1.89E07 |
| 493 | 314 | GSMLFRVTIKSWK | 0.47 | 2.19E07 |
| 494 | 315 | GSMLFRVTINRWK | 0.86 | 1.93E07 |
| 495 | 316 | GSMLFRVTIRSWK | 0.48 | 1.98E07 |
| 496 | 317 | GSMLFRVTINDWK | 2.17 | 9.85E06 |
| 497 | 318 | GSMLFRVTIDSWK | 5.25 | 1.76E07 |
| 498 | 319 | GSMLFRVTINEWK | 1.02 | 1.22E07 |
| 499 | 320 | GSMLFRVTIESWK | 4.25 | 1.71E07 |

FIG. 76

| Pep ID | SEQ ID NO.: | Sequence | SmTrip9 (uM) | Bmax (RLU) |
|---|---|---|---|---|
| 286 | 37 | *SSWKRGSMLFRVTINS | 0.10 | 2.75E7 |
| 445 | 265 | *GSMKFRVTINSWK | 1.02 | 1.84E7 |
| 450 | 266 | *GSMLFRKTINSWK | 1.14 | 4.92E4 |
| 455 | 267 | *GSMLFRVTKNSWK | 0.55 | 3.57E4 |
| 332 | 436 | *GSMLFRVTINS | 0.24 | 2.48E7 |
| 333 | 437 | *GSMLFRVSINS | 0.33 | 2.32E7 |
| 334 | 438 | *GSMLFRVNINS | 5.67 | 2.46E7 |
| 335 | 439 | *GSKLFRVTINS | 9.86 | 3.92E5 |
| 336 | 440 | *GSRLFRVTINS | 0.01 | 1.39E4 |
| 337 | 441 | *GSMWFRVTINS | 6.15 | 9.89E6 |
| 338 | 442 | *GSMSFRVTINS | 7.03 | 1.79E7 |
| 339 | 443 | *GSMNFRVTINS | 8.97 | 5.11E6 |
| 340 | 444 | *GSMKFRVTINS | 0.73 | 1.69E7 |
| 341 | 446 | *GSMLFRWTINS | 0.31 | 7.35E4 |
| 342 | 447 | *GSMLFRSTINS | 4.84 | 6.92E5 |
| 343 | 448 | *GSMLFRNTINS | 3.96 | 1.47E5 |
| 344 | 449 | *GSMLFRKTINS | 0.12 | 2.20E4 |
| 345 | 451 | *GSMLFRVTWNS | 2.24 | 5.51E5 |
| 346 | 452 | *GSMLFRVTSNS | 9.99 | 1.32E6 |
| 347 | 453 | *GSMLFRVTNNS | 14.58 | 2.51E6 |
| 348 | 454 | *GSMLFRVTKNS | 0.21 | 2.60E4 |
| 349 | 456 | *GSMLFRVTIKS | 0.07 | 2.56E7 |
| 310 | 489 | *GSMLFRVTINSWK | 0.51 | 1.38E07 |
| 311 | 490 | GSMLFRVTINSWK* | 12.49 | 8.55E06 |
| 312 | 491 | *GSMLFRVTINSWK* | 0.26 | 1.33E07 |
| 321 | 465 | *GSMRFRVTINSWK* | 10.57 | 1.47E7 |
| 322 | 466 | *GSMDFRVTINSWK* | 0.66 | 4.43E4 |
| 323 | 467 | *GSMEFRVTINSWK* | NA | NA |
| 324 | 468 | *GSMLFRRTINSWK* | NA | 1.27E4 |
| 325 | 469 | *GSMLFRDTINSWK* | NA | 1.29E4 |
| 326 | 470 | *GSMLFRETINSWK* | NA | 1.26E4 |
| 327 | 472 | *GSMLFRVTDNSWK* | 0.09 | 2.60E4 |
| 328 | 473 | *GSMLFRVTENSWK* | 0.02 | 1.70E4 |
| 329 | 474 | *GSMKFRVTINSWK* | 0.24 | 1.35E7 |
| 330 | 475 | *GSMLFRKTINSWK* | 1.97 | 1.64E5 |
| 331 | 476 | *GSMLFRVTKNSWK* | 0.97 | 5.63E4 |
| *Terminus not blocked, NA= not applicable | | | | |

FIG. 77A

| Solubility of Synthetic SmTrip9 peptides ||||
|---|---|---|---|
| Pep ID | SEQ ID NO.: | Sequence | Solubility# |
| 286 | 37 | SSWKRGSMLFRVTINS | Y |
| 292 | 153 | SSWKRMLFRVTINS | N |
| 297 | 157 | SSWKRMLFRVTINSV | Y |
| 302 | 161 | SSWKRMLFRVTINSVS | Y |
| 305 | 164 | SSWKRGSMLFRVTIN | Y |
| 306 | 165 | SSWKRGSMLFRVTI | Y |
| 307 | 166 | SSWKRSMLFRVTIN | Y |
| 308 | 167 | SSWKRMLFRVTIN | N |
| 312 | 171 | SSWKRMLFRVTI | Y |
| 396 | 186 | SSRGSMLFRVTINSWK | Y |
| 397 | 187 | SKRGSMLFRVTINSWS | Y |
| 398 | 188 | SWRGSMLFRVTINS | Y |
| 400 | 189 | SSRGSMLFRVTIWK | Y |
| 401 | 190 | SSWKRGSMLYRVTINS | Y |
| 402 | 191 | SSWKRGSMLWRVTINS | Y |
| 403 | 192 | SSWKRGSMLHRVTINS | Y |
| 404 | 193 | SSWKRGSLLFRVTINS | Y |
| 405 | 194 | SSWKRGSKLFRVTINS | Y |
| 406 | 195 | SSWKRGSRLFRVTINS | Y |
| 407 | 196 | SSWKRGSFLFRVTINS | Y |
| 408 | 197 | SSWKRGSWLFRVTINS | Y |
| 409 | 198 | SSWKRGSMLFRVSINS | Y |
| 410 | 199 | SSWKRGSMLFRVQINS | Y |
| 411 | 200 | SSWKRGSMLFRVNINS | Y |
| 412 | 246 | SSWKRMLFRVTINSVSG | Y |
| 413 | 247 | SSWKRMLFRVTINSVSGW | N |
| 414 | 248 | SSWKRMLFRVTINSVSGWR | Y |
| 415 | 249 | SSWKRMLFRVTINSVSGWK | Y |
| 416 | 225 | MLFRVTINSVSGWR | N |
| 417 | 250 | MLFRVTINSVSGWK | Y |
| 418 | 251 | SSWKRGSMLFRVTINSVSG | N |
| 419 | 252 | SSWKRGSMLFRVTINSVSGW | Y |
| 420 | 253 | SSWKRGSMLFRVTINSVSGWR | Y |
| 421 | 254 | SSWKRGSMLFRVTINSVSGWK | Y |
| 422 | 228 | GSMLFRVTINSVSGWR | Y |
| 423 | 229 | GSMLFRVTINSVSGWK | Y |
| 424 | 255 | SSWKRGSYLFRVTINS | Y |
| 425 | 256 | SSWKRGSMLFRVKINS | Y |
| 426 | 257 | SSWKRGSMLFRVRINS | Y |
| 427 | 258 | SSWKRGSMLFRVWINS | Y |
| 428 | 259 | SSKRGSMLFRVTIWSV | Y |
| 430 | 261 | SSWRGSMLFRVTIKS | Y |
| 431 | 262 | KRSSGSMLFRVTIWS | Y |
| 432 | 263 | SSKRMLFRVTIWS | Y |
| 433 | 264 | KRSSMLFRVTIWS | Y |
| 434 | 230 | GSMLFRVTIWK | Y |
| 435 | 231 | GSMLFRVTINSWK | N |
| 445 | 265 | GSMKFRVTINSWK | Y |
| 450 | 266 | GSMLFRKTINSWK | Y |
| 455 | 267 | GSMLFRVTKNSWK | Y | in water at ~1mM after multiple freeze/thaws
*terminus unblocked

FIG. 77B

| \multicolumn{4}{|c|}{Solubility of Synthetic SmTrip9 peptides} |

| Pep ID | SEQ ID NO.: | Sequence | Solubility# |
|---|---|---|---|
| 521 | 268 | GKMLFRVTINSWK | Y |
| 522 | 269 | GKMLFRVTIWK | Y |
| 523 | 270 | GSMKFRVTINSWK | Y |
| 524 | 271 | GSMKFRVTIWK | Y |
| 525 | 272 | GRMLFRVTINSWK | N |
| 526 | 273 | GRMLFRVTIWK | Y |
| 527 | 274 | GSMRFRVTINSWK | N |
| 528 | 275 | GSMRFRVTIWK | Y |
| 529 | 276 | GDMLFRVTINSWK | Y |
| 530 | 277 | GDMLFRVTIWK | Y |
| 531 | 278 | GSMDFRVTINSWK | Y |
| 532 | 279 | GSMDFRVTIWK | Y |
| 533 | 280 | GEMLFRVTINSWK | Y |
| 535 | 281 | GSMEFRVTINSWK | Y |
| 536 | 282 | GSMEFRVTIWK | Y |
| 538 | 283 | GSMLFRVTIWKVK | Y |
| 539 | 284 | GSMLFRVTIWSVK | Y |
| 540 | 285 | GSMLFRVTIWSK | Y |
| 541 | 286 | GSMLFRVTIWKWK | N |
| 542 | 287 | GSMLFRVTIWKK | Y |
| 436 | 332 | *GSMLFRVTINS | Y |
| 437 | 333 | *GSMLFRVSINS | Y |
| 438 | 334 | *GSMLFRVNINS | Y |
| 439 | 335 | *GSKLFRVTINS | Y |
| 440 | 336 | *GSRLFRVTINS | Y |
| 441 | 337 | *GSMWFRVTINS | N |
| 442 | 338 | *GSMSFRVTINS | Y |
| 443 | 339 | *GSMNFRVTINS | Y |
| 444 | 340 | *GSMKFRVTINS | Y |
| 446 | 341 | *GSMLFRWTINS | Y |
| 447 | 342 | *GSMLFRSTINS | Y |
| 448 | 343 | *GSMLFRNTINS | Y |
| 449 | 344 | *GSMLFRKTINS | Y |
| 451 | 345 | *GSMLFRVTWNS | Y |
| 452 | 346 | *GSMLFRVTSNS | Y |
| 453 | 347 | *GSMLFRVTNNS | Y |
| 454 | 348 | *GSMLFRVTKNS | Y |
| 456 | 349 | *GSMLFRVTIKS | Y |
| 489 | 310 | *GSMLFRVTINSWK | Y |
| 490 | 311 | GSMLFRVTINSWK* | N |
| 491 | 312 | *GSMLFRVTINSWK* | Y |
| 465 | 465 | *GSMRFRVTINSWK* | Y |
| 466 | 466 | *GSMDFRVTINSWK* | Y |
| 467 | 467 | *GSMEFRVTINSWK* | Y |
| 468 | 468 | *GSMLFRRTINSWK* | Y |
| 469 | 469 | *GSMLFRDTINSWK* | N |
| 470 | 470 | *GSMLFRETINSWK* | N |
| 472 | 472 | *GSMLFRVTDNSWK* | Y |
| 473 | 473 | *GSMLFRVTENSWK* | Y |
| 474 | 474 | *GSMKFRVTINSWK* | Y |
| 475 | 475 | *GSMLFRKTINSWK* | Y |
| 476 | 476 | *GSMLFRVTKNSWK* | Y | in water at ~1mM after multiple freeze/thaws
*terminus unblocked

FIG. 82

| Plate | Sequence | Peptide # | Kd/μM | Vmax | Kd normalized | Vmax normalized |
|---|---|---|---|---|---|---|
| | H6WT | 85 | 0.9112 | 2.17E+07 | 1.00 | 1.00 |
| | N5 | 358 | 0.8316 | 1.80E+07 | 0.95 | 1.13 |
| 1 | VA | 359 | 0.535 | 2.46E+07 | 0.59 | 1.13 |
| 1 | VC | 360 | 0.4754 | 2.23E+07 | 0.52 | 1.02 |
| 1 | VD | 361 | 0.8357 | 1.95E+07 | 0.92 | 0.90 |
| 1 | VE | 362 | 0.5682 | 2.28E+07 | 0.62 | 1.05 |
| 1 | VF | 363 | 0.4271 | 2.21E+07 | 0.47 | 1.02 |
| 1 | VG | 364 | 0.6731 | 2.18E+07 | 0.74 | 1.00 |
| 1 | VH | 365 | 0.6099 | 2.05E+07 | 0.67 | 0.95 |
| 1 | VI | 366 | 0.3169 | 2.30E+07 | 0.35 | 1.06 |
| 1 | VK | 367 | 0.666 | 2.17E+07 | 0.73 | 1.00 |
| 1 | VL | 368 | 0.4425 | 2.28E+07 | 0.49 | 1.05 |
| | H6WT | 85 | 0.7146 | 1.82E+07 | 1.00 | 1.00 |
| | N5 | 358 | 0.60 | 2.04E+07 | 0.83 | 1.12 |
| 2 | VM | 369 | 0.3402 | 1.96E+07 | 0.48 | 1.07 |
| 2 | VN | 370 | 0.443 | 1.81E+07 | 0.59 | 0.99 |
| 2 | VP | 371 | 0.5216 | 1.90E+07 | 0.70 | 1.04 |
| 2 | VQ | 372 | 0.4074 | 1.80E+07 | 0.55 | 0.98 |
| 2 | VR | 373 | 0.3884 | 1.71E+07 | 0.52 | 0.94 |
| 2 | VT | 374 | 0.2813 | 1.75E+07 | 0.38 | 0.96 |
| 2 | VV | 375 | 0.216 | 1.85E+07 | 0.29 | 1.01 |
| 2 | VW | 376 | 0.2146 | 1.71E+07 | 0.29 | 0.93 |
| 2 | VY | 377 | 0.3065 | 1.70E+07 | 0.41 | 0.93 |
| 2 | A | 340 | 0.5031 | 1.84E+07 | 0.67 | 1.01 |
| | H6WT | 85 | 0.8451 | 1.81E+07 | 1.00 | 1.00 |
| | N5 | 358 | 0.2446 | 2.22E+07 | 0.37 | 1.12 |
| 3 | C | 341 | 0.5903 | 1.80E+07 | 0.69 | 0.99 |
| 3 | D | 342 | 0.954 | 1.96E+07 | 1.13 | 0.97 |
| 3 | E | 343 | 0.7298 | 2.07E+07 | 0.87 | 1.03 |
| 3 | F | 344 | 0.5474 | 1.95E+07 | 0.65 | 1.01 |
| 3 | G | 148 | 0.7113 | 2.11E+07 | 0.84 | 1.05 |
| 3 | H | 345 | 0.6065 | 1.92E+07 | 0.72 | 0.95 |
| 3 | I | 346 | 0.5149 | 2.01E+07 | 0.61 | 1.00 |
| 3 | K | 347 | 0.7925 | 1.95E+07 | 0.94 | 0.97 |
| 3 | L | 348 | 0.5383 | 1.86E+07 | 0.64 | 0.93 |
| 3 | M | 349 | 0.5381 | 1.92E+07 | 0.64 | 0.95 |
| | H6WT | 85 | 0.8854 | 1.81E+07 | 1.00 | 1.00 |
| | N5 | 358 | 0.27 | 1.96E+07 | 0.31 | 1.09 |
| 4 | N | 93 | 0.667 | 1.73E+07 | 0.74 | 0.95 |
| 4 | P | 350 | 0.6608 | 1.78E+07 | 0.75 | 0.98 |
| 4 | Q | 351 | 0.5036 | 1.65E+07 | 0.57 | 0.91 |
| 4 | R | 352 | 0.6447 | 1.61E+07 | 0.73 | 0.89 |
| 4 | T | 353 | 0.4285 | 1.65E+07 | 0.48 | 0.91 |
| 4 | W | 354 | 0.2579 | 1.66E+07 | 0.29 | 0.91 |
| 4 | Y | 355 | 0.4013 | 1.48E+07 | 0.45 | 0.81 |
| 4 | S | 157 | 0.4579 | 1.55E+07 | 0.52 | 0.85 |
| 4 | N5 | 158 | 0.271 | 1.71E+07 | 0.31 | 0.94 |
| 4 | 229 | 229 | 0.6987 | 1.45E+07 | 0.79 | 0.80 |

FIG. 83

| Extension | peptide ID | Kd (uM) | Bmax | Kd normalized | Bmax normalized |
|---|---|---|---|---|---|
| HiBiT | 86 | 0.68 | 2.50E+07 | 1.00 | 1.00 |
| VS | 289 | 0.23 | 2.92E+07 | 0.34 | 1.17 |
| AW | 457 | 0.19 | 2.75E+07 | 0.29 | 1.10 |
| GW | 458 | 0.19 | 2.88E+07 | 0.27 | 1.15 |
| SW | 459 | 0.19 | 2.90E+07 | 0.28 | 1.16 |
| LW | 460 | 0.22 | 2.84E+07 | 0.32 | 1.14 |
| IW | 461 | 0.20 | 2.70E+07 | 0.30 | 1.08 |
| CW | 462 | 0.38 | 2.72E+07 | 0.57 | 1.09 |
| WW | 463 | 0.46 | 2.62E+07 | 0.68 | 1.05 |
| YW | 464 | 0.22 | 2.77E+07 | 0.33 | 1.11 |

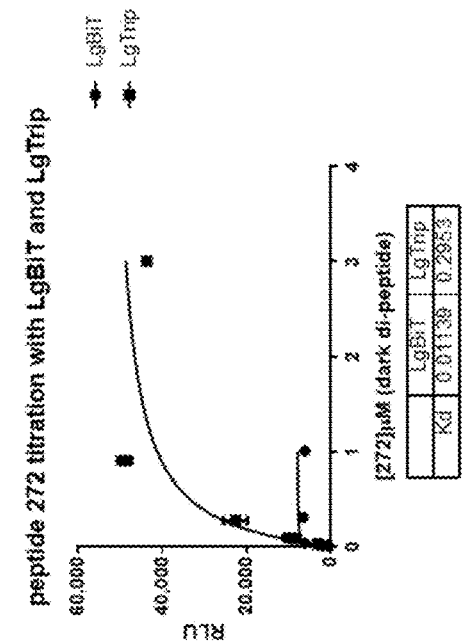
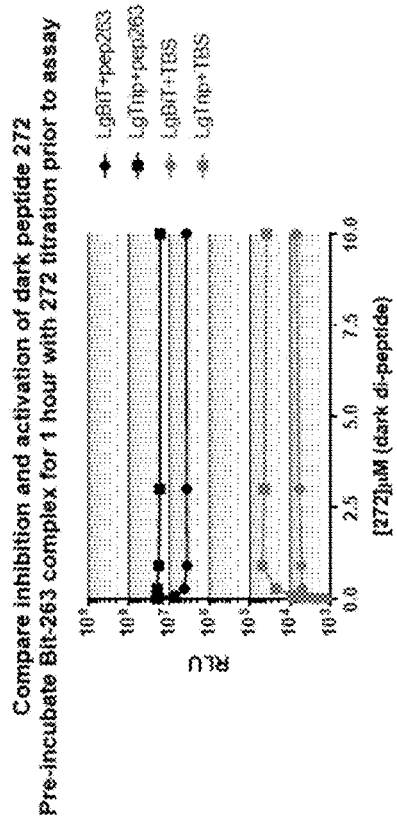
FIG. 86

FIG. 87
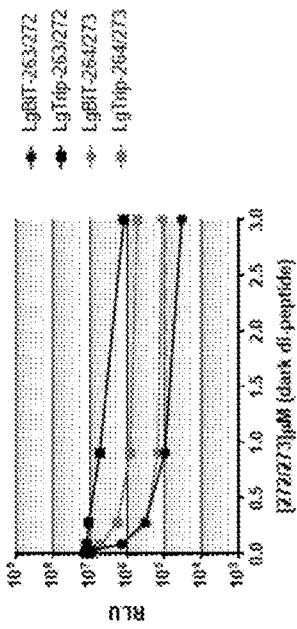
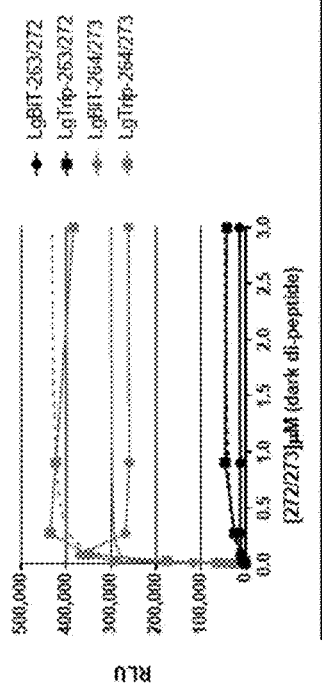
Peptide 273 GSMLFRVTINSGVSGWALFKKIS
Peptide 264 GSMLFRVTINSGVSGWRLFKKIS Peptide 167 VSGWALFKKIS
SEQ ID NO.: 300

FIG. 92

| FKBP construct | | | | | FRB_289 + FKBP_SmTrip9 | | | FRB_86 + FKBP_SmTrip9 | | | FRB_229 + FKBP_SmTrip9 | | |
|---|---|---|---|---|---|---|---|---|---|---|---|---|---|
| ATG# | Pep ID | Pep Sequence | SEQ ID NO. | | With Rap | No Rap | Response | With Rap | No Rap | Response | With Rap | No Rap | Response |
| 3770 | 245 | GSMLFRVTINS | 23 | | 0.53 +/- 0.04 | 0.24 +/- 0.02 | 2.26 +/- 0.11 | 0.41 +/- 0.03 | 0.16 +/- 0.01 | 2.53 +/- 0.07 | 0.21 +/- 0.01 | 0.10 +/- 0.01 | 2.21 +/- 0.34 |
| 3937 | 521 | GKMLFRVTINSWK | 827 | | 1.00 +/- 0.04 | 1.00 +/- 0.07 | 1.00 +/- 0.04 | 0.85 +/- 0.02 | 0.70 +/- 0.01 | 1.21 +/- 0.05 | 0.49 +/- 0.03 | 0.48 +/- 0.03 | 1.02 +/- 0.13 |
| 4543 | 759 | DKLLFTVTIEKYK | 496 | | 0.35 +/- 0.01 | 0.10 +/- 0.01 | 3.70 +/- 0.58 | 0.37 +/- 0.04 | 0.09 +/- 0.02 | 4.33 +/- 1.07 | 0.27 +/- 0.01 | 0.05 +/- 0.01 | 5.02 +/- 0.71 |
| 4792 | 823 | EKLLFTVTIEKYK | 596 | | 0.21 +/- 0.09 | 0.08 +/- 0.00 | 2.47 +/- 0.99 | 0.24 +/- 0.09 | 0.06 +/- 0.02 | 4.13 +/- 0.37 | 0.17 +/- 0.06 | 0.05 +/- 0.00 | 3.30 +/- 0.93 |
| 4793 | 840 | GKLLFTVTIEKYK | 597 | | 0.59 +/- 0.04 | 0.26 +/- 0.03 | 2.25 +/- 0.13 | 0.68 +/- 0.04 | 0.24 +/- 0.01 | 2.82 +/- 0.09 | 0.46 +/- 0.04 | 0.15 +/- 0.01 | 3.17 +/- 0.21 |

FIG. 93

| Biochemical analysis of synthetic SmTrip9 variants ||||
| Pep ID | Sequence | SEQ ID NO. | SmTrip9 Kd (uM) | Bmax (RLU) |
| --- | --- | --- | --- | --- |
| 286 | SSWKRGSMLFRVTINS | 37 | 0.19 | 2.57E+07 |
| 434 | GSMLFRVTIWK | 230 | 0.13 | 2.49E+07 |
| 521 | GKMLFRVTINSWK | 268 | 0.55 | 2.50E+07 |
| 522 | GKMLFRVTIWK | 269 | 0.02 | 2.47E+07 |
| 523 | GSMKFRVTINSWK | 270 | 1.34 | 1.51E+07 |
| 524 | GSMKFRVTIWK | 271 | 0.14 | 2.51E+07 |
| 525 | GRMLFRVTINSWK | 272 | 0.37 | 2.37E+07 |
| 526 | GRMLFRVTIWK | 273 | 0.01 | 2.32E+07 |
| 527 | GSMRFRVTINSWK | 274 | 0.72 | 1.06E+07 |
| 528 | GSMRFRVTIWK | 275 | 0.11 | 2.19E+07 |
| 529 | GDMLFRVTINSWK | 276 | 2.60 | 4.05E+06 |
| 530 | GDMLFRVTIWK | 277 | 0.54 | 2.23E+07 |
| 531 | GSMDFRVTINSWK | 278 | 1.74 | 1.32E+07 |
| 532 | GSMDFRVTIWK | 279 | 0.43 | 4.43E+06 |
| 533 | GEMLFRVTINSWK | 280 | 0.34 | 5.26E+06 |
| 535 | GSMEFRVTINSWK | 281 | 0.95 | 8.56E+06 |
| 536 | GSMEFRVTIWK | 282 | 0.18 | 1.63E+07 |
| 538 | GSMLFRVTIWKVK | 283 | 0.12 | 2.28E+07 |
| 539 | GSMLFRVTIWSVK | 284 | 0.03 | 1.82E+07 |
| 540 | GSMLFRVTIWSK | 285 | 0.15 | 2.11E+07 |
| 541 | GSMLFRVTIWKWK | 286 | 0.13 | 1.76E+07 |
| 542 | GSMLFRVTIWKK | 287 | 0.07 | 2.35E+07 |

Chemical Formula: $C_{68}H_{112}N_{19}O_{15}S^{3+}$
Exact Mass: 1466.83

Chemical Formula: $C_{71}H_{117}N_{22}O_{15}^{3+}$
Exact Mass: 1517.91

Chemical Formula: $C_{75}H_{118}N_{20}O_{19}S_{2}^{4+}$
Exact Mass: 1666.83

Chemical Formula: $C_{70}H_{112}N_{19}O_{15}{}^{3+}$
Exact Mass: 1458.86

Chemical Formula: $C_{100}H_{139}BF_2N_{23}O_{16}{}^{3+}$
Exact Mass: 1967.08

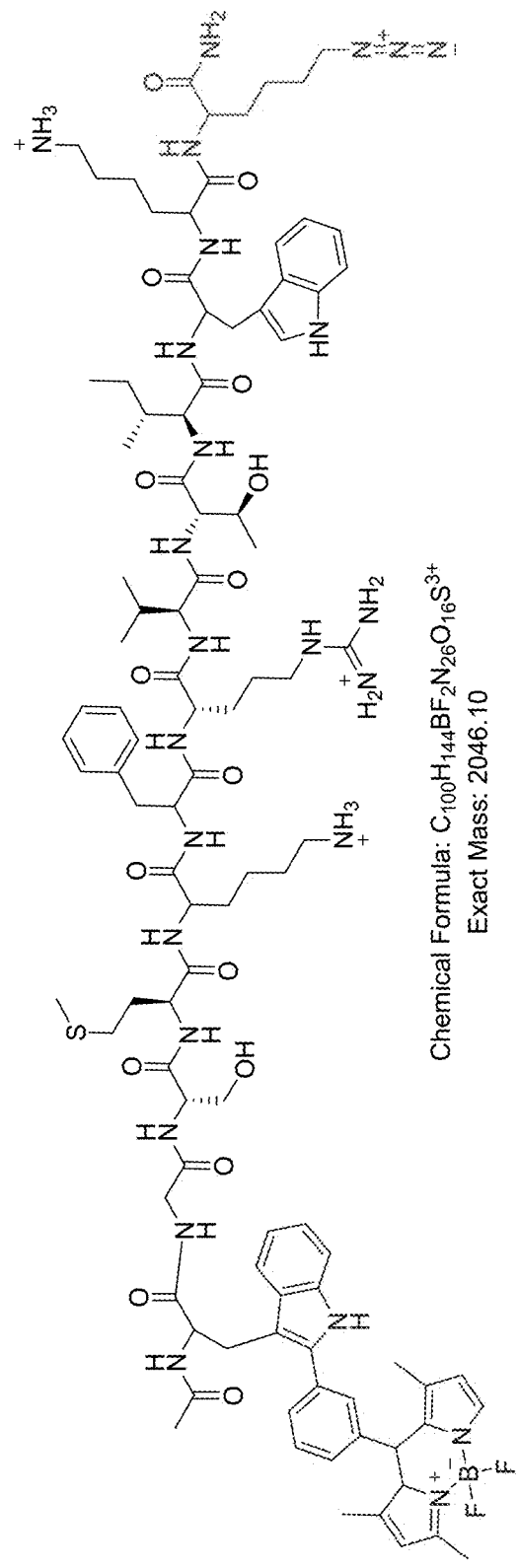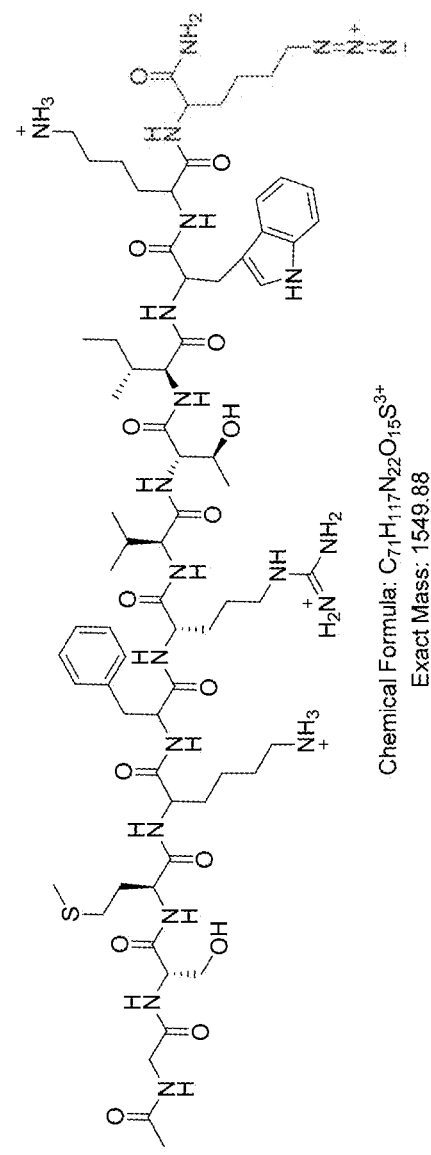
FIG. 98A
FIG. 98B

SmTrip9-286 with C-term azide

Trip9-286 peptide

SEQ ID NO.: 33 aagtcgagaaccatgaccac

Expected mass: 8229.27
Measured mass: 8229.4

FIG. 113

SmTrip9 on FKBP N-term

| FKBP construct | | | | FRB_289 + SmTrip9_FKBP | | | FRB_86 + SmTrip9_FKBP | | |
|---|---|---|---|---|---|---|---|---|---|
| ATG# | Pep ID | Pep Sequence | SEQ ID NO. | With Rap | No Rap | Response | With Rap | No Rap | Response |
| 2825 | 245 | GSMLFRVTINS | 23 | 0.05 | 0.08 | 0.63 | 0.04 | 0.06 | 0.63 |
| 3637 | 286 | SSWKRGSMLFRVTINS | 37 | 0.27 | 0.17 | 1.53 | 0.17 | 0.21 | 0.82 |
| 3823 | 435 | GSMLFRVTINSWK | 231 | 0.05 | 0.08 | 0.66 | 0.05 | 0.06 | 0.82 |
| 3826 | 434 | GSMLFRVTIWK | 230 | 0.11 | 0.25 | 0.41 | 0.12 | 0.48 | 0.25 |
| 3864 | 492 | GSMLFRVTINKWK | 313 | 0.09 | 0.09 | 1.02 | 0.10 | 0.10 | 0.95 |
| 3865 | 493 | GSMLFRVTIKSWK | 314 | 0.08 | 0.13 | 0.61 | 0.07 | 0.12 | 0.57 |
| 3866 | 521 | GKMLFRVTINSWK | 827 | 1.00 | 1.00 | 1.00 | 1.00 | 1.00 | 1.00 |
| 3867 | 522 | GKMLFRVTIWK | 269 | 1.30 | 4.79 | 0.27 | 1.68 | 10.80 | 0.16 |
| 3868 | 523 | GSMKFRVTINSWK | 265 | 0.04 | 0.05 | 0.65 | 0.01 | 0.04 | 0.26 |
| 3869 | 524 | GSMKFRVTIWK | 271 | 0.32 | 0.18 | 1.80 | 0.29 | 0.25 | 1.17 |
| 3870 | 538 | GSMLFRVTIWKVK | 283 | 0.10 | 0.35 | 0.28 | 0.10 | 0.66 | 0.15 |
| 3871 | 541 | GSMLFRVTIWKWK | 286 | 0.04 | 0.13 | 0.33 | 0.05 | 0.23 | 0.21 |
| 3872 | 542 | GSMLFRVTIWKK | 287 | 0.08 | 0.28 | 0.28 | 0.09 | 0.50 | 0.18 |

FIG. 114

SmTrip9 on FKBP C-term
Data normalized to 521

| FKBP construct | | | | FRB_289 + FKBP_SmTrip9 | | | FRB_86 + FKBP_SmTrip9 | | |
|---|---|---|---|---|---|---|---|---|---|
| ATG# | Pep ID | Pep Sequence | SEQ ID NO. | With Rap | No Rap | Response | With Rap | No Rap | Response |
| 3770 | 245 | GSMLFRVTINS | 23 | 0.38 | 0.48 | 0.81 | 0.40 | 0.53 | 0.75 |
| 3639 | 286 | SSWKRGSMLFRVTINS | 37 | 0.05 | 0.32 | 0.14 | 0.05 | 0.42 | 0.13 |
| 3828 | 434 | GSMLFRVTIWK | 230 | 1.38 | 1.55 | 0.89 | 2.47 | 2.42 | 1.02 |
| 3829 | 435 | GSMLFRVTINSWK | 231 | 0.86 | 0.72 | 1.20 | 0.86 | 0.76 | 1.13 |
| 3936 | 493 | GSMLFRVTIKSWK | 314 | 1.12 | 1.10 | 1.02 | 1.34 | 1.14 | 1.18 |
| 3937 | 521 | GKMLFRVTINSWK | 827 | 1.00 | 1.00 | 1.00 | 1.00 | 1.00 | 1.00 |
| 3938 | 522 | GKMLFRVTIWK | 269 | 1.16 | 2.30 | 0.50 | 2.09 | 3.52 | 0.59 |
| 3939 | 523 | GSMKFRVTINSWK | 265 | 0.02 | 0.33 | 0.06 | 0.01 | 0.42 | 0.03 |
| 3940 | 524 | GSMKFRVTIWK | 271 | 0.33 | 0.57 | 0.57 | 0.38 | 0.73 | 0.52 |
| 3942 | 499 | GSMLFRVTIESWK | 320 | 1.45 | 1.24 | 1.17 | 1.33 | 1.02 | 1.31 |

FIG. 115

| FKBP construct | | | | FRB_289 + SmTrip9_FKBP | | | FRB_86 + SmTrip9_FKBP | | |
|---|---|---|---|---|---|---|---|---|---|
| ATG# | Pep ID | Pep Sequence | SEQ ID NO. | With Rap | No Rap | Response | With Rap | No Rap | Response |
| 3770 | 245 | GSMLFRVTINS | 23 | 0.05 | 0.10 | 0.55 | 0.04 | 0.15 | 0.26 |
| 3639 | 286 | SSWKRGSMLFRVTINS | 37 | 0.15 | 0.16 | 0.94 | 0.10 | 0.19 | 0.51 |
| 3828 | 434 | GSMLFRVTIWK | 230 | 0.12 | 0.35 | 0.35 | 0.16 | 0.64 | 0.26 |
| 3829 | 435 | GSMLFRVTINSWK | 231 | 0.06 | 0.11 | 0.58 | 0.06 | 0.11 | 0.49 |
| 3936 | 493 | GSMLFRVTIKSWK | 314 | 0.06 | 0.13 | 0.44 | 0.06 | 0.15 | 0.36 |
| 3937 | 521 | GKMLFRVTINSWK | 827 | 1.00 | 1.00 | 1.00 | 1.00 | 1.00 | 1.00 |
| 3938 | 522 | GKMLFRVTIWK | 269 | 1.25 | 5.87 | 0.21 | 1.87 | 9.63 | 0.19 |
| 3939 | 523 | GSMKFRVTINSWK | 265 | 0.03 | 0.08 | 0.37 | 0.01 | 0.11 | 0.07 |
| 3940 | 524 | GSMKFRVTIWK | 271 | 0.24 | 0.22 | 1.06 | 0.24 | 0.29 | 0.81 |
| 3942 | 499 | GSMLFRVTIESWK | 320 | 0.14 | 0.18 | 0.76 | 0.11 | 0.16 | 0.70 |

FIG. 116A

| FKBP construct | | | SEQ ID NO. | FRB_289 + FKBP_SmTrip9 | | |
|---|---|---|---|---|---|---|
| ATG# | Pep ID | Pep Sequence | | With Rap | No Rap | Response |
| 3937 | 521 | GKMLFRVTINSWK | 827 | 1.00 | 1.00 | 1.00 |
| 4262 | 671 | GKMLFRVTIQKWK | 391 | 1.53 | 3.60 | 0.43 |
| 4259 | 668 | GKMLFRVTIGKWK | 392 | 1.32 | 2.30 | 0.57 |
| 4260 | 727 | GKMLFRVTIGRWK | 393 | 1.24 | 2.47 | 0.50 |
| 4257 | 669 | GKMLFRVTIGNWK | 394 | 1.02 | 1.35 | 0.75 |
| 4263 | 674 | GKMLFRVTIQNWK | 395 | 0.90 | 1.50 | 0.60 |
| 4339 | 702 | GKMLFRVTIDKWK | 396 | 0.58 | 0.67 | 0.87 |
| 4340 | 703 | GKMLFRVTIEKWK | 397 | 0.78 | 1.65 | 0.47 |
| 4341 | 730 | GKMLFRVTIERWK | 398 | 0.00 | 0.25 | 0.01 |
| 4342 | 731 | GKMLFRVTIDRWK | 399 | 0.67 | 0.73 | 0.92 |
| 4343 | 738 | DKMLFRVTIQKWK | 400 | 0.82 | 0.57 | 1.44 |
| 4344 | 739 | DKMLFRVTIGKWK | 401 | 0.51 | 0.45 | 1.13 |
| 4345 | 848 | DKMLFRVTIGRWK | 402 | 0.63 | 0.47 | 1.33 |
| 4346 | 740 | DKMLFRVTIGNWK | 403 | 0.55 | 0.41 | 1.35 |
| 4347 | 741 | DKMLFRVTIQNWK | 404 | 0.58 | 0.43 | 1.33 |
| 4348 | 732 | DKMLFRVTIDKWK | 405 | 0.23 | 0.33 | 0.70 |
| 4349 | 742 | DKMLFRVTIEKWK | 406 | 0.58 | 0.48 | 1.21 |
| 4350 | 735 | DKMLFRVTIERWK | 407 | 0.29 | 0.37 | 0.79 |
| 4351 | 733 | DKMLFRVTIDRWK | 408 | 0.32 | 0.34 | 0.93 |

| | | | | | | |
|---|---|---|---|---|---|---|
| 4352 | 849 | EKMLFRVTIQKWK | 410 | 0.80 | 0.65 | 1.23 |
| 4353 | 708 | EKMLFRVTIGKWK | 411 | 0.78 | 0.59 | 1.33 |
| 4354 | 709 | EKMLFRVTIGRWK | 412 | 0.69 | 0.54 | 1.28 |
| 4355 | 850 | EKMLFRVTIGNWK | 439 | 0.62 | 0.47 | 1.32 |
| 4356 | 851 | EKMLFRVTIQNWK | 440 | 0.60 | 0.51 | 1.17 |
| 4357 | 706 | EKMLFRVTIDKWK | 441 | 0.32 | 0.37 | 0.87 |
| 4358 | 707 | EKMLFRVTIEKWK | 442 | 0.59 | 0.52 | 1.13 |
| 4359 | 737 | EKMLFRVTIERWK | 443 | 0.26 | 0.40 | 0.65 |
| 4360 | 736 | EKMLFRVTIDRWK | 444 | 0.32 | 0.37 | 0.86 |
| 4361 | 760 | KKMLFRVTIQKWK | 445 | 1.35 | 27.31 | 0.05 |
| 4362 | 852 | KKMLFRVTIGKWK | 446 | 1.34 | 16.45 | 0.08 |
| 4363 | 853 | KKMLFRVTIGRWK | 447 | 1.06 | 15.19 | 0.07 |
| 4364 | 854 | KKMLFRVTIGNWK | 448 | 1.48 | 12.45 | 0.12 |
| 4365 | 855 | KKMLFRVTIQNWK | 449 | 1.78 | 18.75 | 0.09 |
| 4366 | 856 | KKMLFRVTIDKWK | 450 | 1.23 | 4.82 | 0.26 |
| 4367 | 857 | KKMLFRVTIEKWK | 451 | 1.24 | 14.92 | 0.08 |
| 4368 | 858 | KKMLFRVTIERWK | 452 | 0.45 | 6.05 | 0.07 |
| 4369 | 859 | KKMLFRVTIDRWK | 453 | 0.98 | 4.05 | 0.24 |
| 4370 | 860 | RKMLFRVTIQKWK | 454 | 1.30 | 27.15 | 0.05 |
| 4371 | 861 | RKMLFRVTIGKWK | 455 | 1.50 | 20.53 | 0.07 |
| 4372 | 862 | RKMLFRVTIGRWK | 456 | 1.20 | 19.17 | 0.06 |
| 4373 | 863 | RKMLFRVTIGNWK | 457 | 1.35 | 13.87 | 0.10 |
| 4374 | 864 | RKMLFRVTIQNWK | 458 | 1.27 | 18.12 | 0.07 |
| 4375 | 865 | RKMLFRVTIDKWK | 459 | 0.85 | 4.61 | 0.18 |
| 4376 | 866 | RKMLFRVTIEKWK | 460 | 0.80 | 14.05 | 0.06 |

FIG. 116B

| | | | | | | |
|---|---|---|---|---|---|---|
| 4377 | 867 | RKMLFRVTIERWK | 461 | 0.36 | 6.68 | 0.05 |
| 4378 | 868 | RKMLFRVTIDRWK | 462 | 0.82 | 4.84 | 0.17 |
| 4291 | 656 | EQMLFRVTINSWK | 463 | 0.49 | 0.41 | 1.18 |
| 4292 | 869 | SRMLFRVTINSWK | 464 | 0.94 | 1.50 | 0.63 |
| 4293 | 533 | GEMLFRVTINSWK | 465 | 0.57 | 0.39 | 1.44 |
| 4331 | 690 | GKMKFRVTINSWK | 466 | 0.12 | 0.43 | 0.27 |
| 4332 | 678 | GKMLFRVKINSWK | 467 | 0.15 | 0.50 | 0.30 |
| 4333 | 679 | GKMLFRVRINSWK | 468 | 0.26 | 0.65 | 0.40 |
| 4334 | 681 | GKMLFRVDINSWK | 469 | 0.00 | 0.39 | 0.00 |

| FKBP construct | | | | FRB_289 + FKBP_SmTrip9 | | |
|---|---|---|---|---|---|---|
| ATG# | Pep ID | Pep Sequence | SEQ ID NO. | With Rap | No Rap | Response |
| 3937 | 521 | GKMLFRVTINSWK | 827 | 1.00 | 1.00 | 1.00 |
| 4339 | 702 | GKMLFRVTIDKWK | 396 | 0.90 | 0.85 | 1.05 |
| 4340 | 703 | GKMLFRVTIEKWK | 397 | 0.96 | 1.71 | 0.56 |
| 4341 | 730 | GKMLFRVTIERWK | 398 | 0.00 | 0.32 | 0.01 |
| 4342 | 731 | GKMLFRVTIDRWK | 399 | 0.74 | 0.75 | 0.99 |
| 4343 | 738 | DKMLFRVTIQKWK | 400 | 1.11 | 0.64 | 1.72 |
| 4344 | 739 | DKMLFRVTIGKWK | 401 | 1.02 | 0.54 | 1.89 |
| 4345 | 848 | DKMLFRVTIGRWK | 402 | 1.00 | 0.61 | 1.64 |
| 4346 | 740 | DKMLFRVTIGNWK | 403 | 0.75 | 0.43 | 1.74 |
| 4347 | 741 | DKMLFRVTIQNWK | 404 | 0.74 | 0.50 | 1.48 |
| 4348 | 732 | DKMLFRVTIDKWK | 405 | 0.38 | 0.37 | 1.02 |
| 4349 | 742 | DKMLFRVTIEKWK | 406 | 0.63 | 0.44 | 1.42 |
| 4350 | 735 | DKMLFRVTIERWK | 407 | 0.27 | 0.38 | 0.72 |
| 4351 | 733 | DKMLFRVTIDRWK | 408 | 0.34 | 0.35 | 0.98 |
| 4352 | 849 | EKMLFRVTIQKWK | 410 | 1.11 | 0.73 | 1.51 |
| 4353 | 708 | EKMLFRVTIGKWK | 411 | 1.07 | 0.64 | 1.67 |
| 4354 | 709 | EKMLFRVTIGRWK | 412 | 0.78 | 0.57 | 1.36 |
| 4355 | 850 | EKMLFRVTIGNWK | 439 | 0.76 | 0.47 | 1.62 |
| 4356 | 851 | EKMLFRVTIQNWK | 440 | 0.74 | 0.48 | 1.56 |
| 4357 | 706 | EKMLFRVTIDKWK | 441 | 0.41 | 0.36 | 1.14 |
| 4358 | 707 | EKMLFRVTIEKWK | 442 | 0.59 | 0.47 | 1.25 |
| 4359 | 737 | EKMLFRVTIERWK | 443 | 0.24 | 0.35 | 0.69 |
| 4360 | 736 | EKMLFRVTIDRWK | 444 | 0.41 | 0.41 | 1.02 |
| 4185 | 663 | GKMLFRVTIDSWK | 470 | 0.53 | 0.56 | 0.95 |
| 4196 | 743 | GKMLFRVTINKWK | 471 | 1.15 | 1.24 | 0.92 |

FIG. 118

| FKBP construct | | | | FRB_289 + FKBP_SmTrip9 | | |
|---|---|---|---|---|---|---|
| ATG# | Pep ID | Pep Sequence | SEQ ID NO. | With Rap | No Rap | Response |
| 3937 | 521 | GKMLFRVTINSWK | 827 | 1.00 | 1.00 | 1.00 |
| 4339 | 702 | GKMLFRVTIDKWK | 396 | 0.62 | 0.71 | 0.88 |
| 4340 | 703 | GKMLFRVTIEKWK | 397 | 0.96 | 1.47 | 0.65 |
| 4341 | 730 | GKMLFRVTIERWK | 398 | 0.00 | 0.42 | 0.00 |
| 4342 | 731 | GKMLFRVTIDRWK | 399 | 0.62 | 0.74 | 0.83 |
| 4343 | 738 | DKMLFRVTIQKWK | 400 | 0.84 | 0.63 | 1.34 |
| 4344 | 739 | DKMLFRVTIGKWK | 401 | 0.66 | 0.61 | 1.09 |
| 4345 | 848 | DKMLFRVTIGRWK | 402 | 0.71 | 0.65 | 1.09 |
| 4346 | 740 | DKMLFRVTIGNWK | 403 | 0.54 | 0.52 | 1.03 |
| 4347 | 741 | DKMLFRVTIQNWK | 404 | 0.56 | 0.52 | 1.07 |
| 4348 | 732 | DKMLFRVTIDKWK | 405 | 0.27 | 0.45 | 0.61 |
| 4349 | 742 | DKMLFRVTIEKWK | 406 | 0.57 | 0.52 | 1.10 |
| 4350 | 735 | DKMLFRVTIERWK | 407 | 0.25 | 0.45 | 0.56 |
| 4351 | 733 | DKMLFRVTIDRWK | 408 | 0.24 | 0.39 | 0.62 |
| 4352 | 849 | EKMLFRVTIQKWK | 410 | 0.81 | 0.66 | 1.24 |
| 4353 | 708 | EKMLFRVTIGKWK | 411 | 0.70 | 0.62 | 1.13 |
| 4354 | 709 | EKMLFRVTIGRWK | 412 | 0.67 | 0.59 | 1.14 |
| 4355 | 850 | EKMLFRVTIGNWK | 439 | 0.59 | 0.50 | 1.18 |
| 4356 | 851 | EKMLFRVTIQNWK | 440 | 0.62 | 0.57 | 1.08 |
| 4357 | 706 | EKMLFRVTIDKWK | 441 | 0.30 | 0.40 | 0.74 |
| 4358 | 707 | EKMLFRVTIEKWK | 442 | 0.50 | 0.55 | 0.91 |
| 4359 | 737 | EKMLFRVTIERWK | 443 | 0.23 | 0.41 | 0.56 |
| 4360 | 736 | EKMLFRVTIDRWK | 444 | 0.30 | 0.44 | 0.68 |
| 4185 | 663 | GKMLFRVTIDSWK | 470 | 0.46 | 0.58 | 0.79 |
| 4196 | 743 | GKMLFRVTINKWK | 471 | 0.92 | 1.03 | 0.89 |

FIG. 119

| FKBP construct | | | SEQ ID NO. | FRB_289 + FKBP_SmTrip9 | | |
|---|---|---|---|---|---|---|
| ATG# | Pep ID | Pep Sequence | | With Rap | No Rap | Response |
| 3937 | 521 | GKMLFRVTINSWK | 827 | 1.00 | 1.00 | 1.00 |
| 4343 | 738 | DKMLFRVTIQKWK | 400 | 0.98 | 0.56 | 1.76 |
| 4349 | 742 | DKMLFRVTIEKWK | 406 | 0.58 | 0.45 | 1.31 |
| 4196 | 743 | GKMLFRVTINKWK | 471 | 1.21 | 1.23 | 0.98 |
| 4344 | 739 | DKMLFRVTIGKWK | 401 | 0.63 | 0.38 | 1.66 |
| 4409 | 714 | EKMLFKVTIQKWK | 472 | 0.68 | 0.35 | 1.93 |
| 4410 | 870 | EKMLFTVTIQKWK | 473 | 0.42 | 0.25 | 1.69 |
| 4411 | 871 | EKMLFKVTIDKWK | 474 | 0.14 | 0.24 | 0.60 |
| 4412 | 872 | EKMLFTVTIDKWK | 475 | 0.11 | 0.20 | 0.55 |
| 4413 | 873 | EKMLFKVTIGRWK | 476 | 0.60 | 0.31 | 1.93 |
| 4415 | 744 | DKMLFKVTIQKWK | 477 | 0.57 | 0.28 | 2.03 |
| 4416 | 745 | DKMLFTVTIQKWK | 478 | 0.46 | 0.25 | 1.82 |
| 4417 | 874 | DKMLFKVTIDKWK | 479 | 0.16 | 0.17 | 0.96 |
| 4418 | 875 | DKMLFTVTIDKWK | 480 | 0.12 | 0.16 | 0.76 |
| 4419 | 876 | GKMLFKVTIEKWK | 481 | 0.72 | 0.67 | 1.07 |
| 4420 | 877 | GKMLFTVTIEKWK | 482 | 0.48 | 0.35 | 1.38 |
| 4421 | 748 | DKMLFKVTIGKWK | 483 | 0.57 | 0.26 | 2.17 |
| 4422 | 749 | DKMLFTVTIGKWK | 484 | 0.33 | 0.20 | 1.69 |
| 4423 | 878 | DKMLFKVTIGNWK | 485 | 0.39 | 0.23 | 1.70 |
| 4424 | 879 | DKMLFKVTIQNWK | 486 | 0.32 | 0.25 | 1.28 |
| 4425 | 781 | GKMLFKVTINKWK | 487 | 0.77 | 0.47 | 1.61 |
| 4426 | 782 | GKMLFTVTINKWK | 488 | 0.59 | 0.23 | 2.52 |

FIG. 120

| FKBP construct | | | | FRB_289 + FKBP_SmTrip9 | | |
|---|---|---|---|---|---|---|
| ATG# | Pep ID | Pep Sequence | SEQ ID NO. | With Rap | No Rap | Response |
| 3937 | 521 | GKMLFRVTINSWK | 827 | 1.00 | 1.00 | 1.00 |
| 3770 | 245 | GSMLFRVTINS | 288 | 0.53 | 0.32 | 1.67 |
| 4343 | 738 | DKMLFRVTIQKWK | 400 | 0.98 | 0.53 | 1.85 |
| 4349 | 742 | DKMLFRVTIEKWK | 406 | 0.77 | 0.37 | 2.08 |
| 4196 | 743 | GKMLFRVTINKWK | 471 | 1.14 | 1.37 | 0.83 |
| 4344 | 739 | DKMLFRVTIGKWK | 401 | 0.85 | 0.37 | 2.33 |
| 4409 | 714 | EKMLFKVTIQKWK | 472 | 0.69 | 0.28 | 2.49 |
| 4410 | 870 | EKMLFTVTIQKWK | 473 | 0.60 | 0.19 | 3.18 |
| 4411 | 871 | EKMLFKVTIDKWK | 474 | 0.19 | 0.13 | 1.46 |
| 4412 | 872 | EKMLFTVTIDKWK | 475 | 0.14 | 0.11 | 1.27 |
| 4413 | 873 | EKMLFKVTIGRWK | 476 | 0.64 | 0.24 | 2.72 |
| 4415 | 744 | DKMLFKVTIQKWK | 477 | 0.67 | 0.21 | 3.20 |
| 4416 | 745 | DKMLFTVTIQKWK | 478 | 0.53 | 0.13 | 4.06 |
| 4417 | 874 | DKMLFKVTIDKWK | 479 | 0.20 | 0.10 | 1.98 |
| 4418 | 875 | DKMLFTVTIDKWK | 480 | 0.14 | 0.09 | 1.53 |
| 4419 | 876 | GKMLFKVTIEKWK | 481 | 0.78 | 0.70 | 1.11 |
| 4420 | 877 | GKMLFTVTIEKWK | 482 | 0.63 | 0.27 | 2.35 |
| 4421 | 748 | DKMLFKVTIGKWK | 483 | 0.59 | 0.19 | 3.02 |
| 4422 | 749 | DKMLFTVTIGKWK | 484 | 0.41 | 0.11 | 3.77 |
| 4423 | 878 | DKMLFKVTIGNWK | 485 | 0.45 | 0.14 | 3.29 |
| 4424 | 879 | DKMLFKVTIQNWK | 486 | 0.42 | 0.17 | 2.52 |
| 4425 | 781 | GKMLFKVTINKWK | 487 | 0.67 | 0.40 | 1.69 |
| 4426 | 782 | GKMLFTVTINKWK | 488 | 0.59 | 0.17 | 3.51 |

FIG. 121

| FKBP construct | | | | FRB_289 + FKBP_SmTrip9 | | | FRB_86 + FKBP_SmTrip9 | | |
|---|---|---|---|---|---|---|---|---|---|
| ATG# | Pep ID | Pep Sequence | SEQ ID NO. | With Rap | No Rap | Response | With Rap | No Rap | Response |
| 3937 | 521 | GKMLFRVTINSWK | 827 | 1.00 +/- 0.12 | 1.00 +/- 0.16 | 1.00 +/- 0.10 | 1.09 +/- 0.09 | 0.64 +/- 0.12 | 1.69 +/- 0.07 |
| 3770 | 245 | GSMLFRVTINS | 288 | 0.61 +/- 0.15 | 0.26 +/- 0.10 | 2.45 +/- 0.33 | 0.51 +/- 0.05 | 0.11 +/- 0.03 | 4.53 +/- 0.13 |
| 4416 | 745 | DKMLFTVTIQKWK | 478 | 0.56 +/- 0.10 | 0.06 +/- 0.01 | 8.72 +/- 0.65 | 0.78 +/- 0.11 | 0.08 +/- 0.02 | 9.99 +/- 0.90 |
| 4422 | 749 | DKMLFTVTIGKWK | 484 | 0.40 +/- 0.03 | 0.04 +/- 0.00 | 9.59 +/- 0.39 | 0.63 +/- 0.03 | 0.06 +/- 0.01 | 10.84 +/- 0.54 |
| 4460 | 752 | DKMLFKVTIEKWK | 489 | 0.43 +/- 0.03 | 0.08 +/- 0.01 | 5.52 +/- 0.31 | 0.51 +/- 0.01 | 0.08 +/- 0.01 | 6.72 +/- 0.37 |
| 4461 | 753 | DKMLFTVTIEKWK | 490 | 0.49 +/- 0.06 | 0.06 +/- 0.01 | 8.80 +/- 1.20 | 0.66 +/- 0.08 | 0.05 +/- 0.01 | 12.05 +/- 0.44 |
| 4466 | 750 | DKLLFKVTIGKWK | 491 | 0.47 +/- 0.01 | 0.08 +/- 0.01 | 5.71 +/- 0.54 | 0.71 +/- 0.02 | 0.09 +/- 0.01 | 7.42 +/- 0.21 |
| 4467 | 786 | DKMLFTVTINKWK | 492 | 0.26 +/- 0.02 | 0.03 +/- 0.01 | 8.97 +/- 1.17 | 0.35 +/- 0.01 | 0.03 +/- 0.01 | 10.54 +/- 0.38 |
| 4468 | 756 | DKLLFTVTIQKWK | 493 | 0.50 +/- 0.10 | 0.07 +/- 0.01 | 7.23 +/- 0.70 | 0.71 +/- 0.10 | 0.07 +/- 0.01 | 10.71 +/- 0.36 |
| 4472 | 757 | DKLLFTVTIQKYK | 494 | 0.43 +/- 0.04 | 0.05 +/- 0.01 | 8.28 +/- 0.66 | 0.60 +/- 0.06 | 0.05 +/- 0.01 | 11.68 +/- 0.77 |
| 4542 | 758 | DKLLFTVTIEKWK | 495 | 0.37 +/- 0.03 | 0.05 +/- 0.01 | 6.99 +/- 1.24 | 0.50 +/- 0.02 | 0.05 +/- 0.01 | 10.21 +/- 0.56 |
| 4543 | 759 | DKLLFTVTIEKYK | 496 | 0.38 +/- 0.04 | 0.04 +/- 0.00 | 9.36 +/- 0.47 | 0.48 +/- 0.04 | 0.05 +/- 0.00 | 9.63 +/- 0.24 |
| 4544 | 793 | DKLLFTVTIGKWK | 497 | 0.50 +/- 0.09 | 0.05 +/- 0.01 | 9.63 +/- 0.94 | 0.78 +/- 0.10 | 0.06 +/- 0.01 | 12.93 +/- 0.53 |
| 4545 | 794 | DKLLFTVTIGKYK | 498 | 0.26 +/- 0.03 | 0.02 +/- 0.00 | 11.19 +/- 1.09 | 0.38 +/- 0.04 | 0.03 +/- 0.01 | 12.97 +/- 0.40 |
| 4546 | 799 | DKLLFTVTINKWK | 499 | 0.28 +/- 0.05 | 0.03 +/- 0.00 | 9.95 +/- 2.42 | 0.36 +/- 0.04 | 0.03 +/- 0.00 | 11.60 +/- 1.03 |
| 4547 | 800 | DKLLFTVTINKYK | 500 | 0.17 +/- 0.01 | 0.02 +/- 0.01 | 7.95 +/- 2.83 | 0.23 +/- 0.01 | 0.02 +/- 0.00 | 10.95 +/- 0.86 |

FIG. 122A

| FKBP construct | | | | FRB_289 + FKBP_SmTrip9 | | |
|---|---|---|---|---|---|---|
| ATG# | Pep ID | Pep Sequence | SEQ ID NO. | With Rap | No Rap | Response |
| 3770 | 245 | GSMLFRVTINS | 288 | 0.52 +/- 0.06 | 0.23 +/- 0.07 | 2.30 +/- 0.47 |
| 3937 | 521 | GKMLFRVTINSWK | 827 | 1.00 +/- 0.00 | 1.00 +/- 0.00 | 1.00 +/- 0.00 |
| 4455 | 780 | GKMLFRVTINS | 501 | 0.58 +/- 0.04 | 0.37 +/- 0.10 | 1.65 +/- 0.52 |
| 4416 | 745 | DKMLFTVTIQKWK | 478 | 0.63 +/- 0.19 | 0.28 +/- 0.32 | 6.34 +/- 6.31 |
| 4456 | 765 | DKMLFTVTIQK | 502 | 0.30 +/- 0.06 | 0.04 +/- 0.00 | 7.33 +/- 1.56 |
| 4415 | 744 | DKMLFKVTIQKWK | 477 | 0.60 +/- 0.05 | 0.16 +/- 0.03 | 3.93 +/- 1.03 |
| 4436 | 779 | DKMLFKVTIQK | 503 | 0.40 +/- 0.06 | 0.11 +/- 0.07 | 5.19 +/- 3.57 |
| 4544 | 793 | DKLLFTVTIQK | 497 | 0.42 +/- 0.00 | 0.18 +/- 0.20 | 6.36 +/- 6.96 |
| 4618 | 820 | DKLLFTVTIGK | 504 | 0.19 +/- 0.03 | 0.03 +/- 0.00 | 7.44 +/- 0.03 |
| 4422 | 749 | DKMLFTVTIGKWK | 484 | 0.49 +/- 0.04 | 0.07 +/- 0.01 | 7.21 +/- 1.89 |
| 4619 | 819 | DKMLFTVTIGK | 505 | 0.22 +/- 0.02 | 0.05 +/- 0.04 | 7.15 +/- 4.92 |
| 4461 | 753 | DKMLFTVTIEKWK | 490 | 0.52 +/- 0.02 | 0.20 +/- 0.22 | 7.29 +/- 7.94 |
| 4620 | 822 | DKMLFTVTIEK | 506 | 0.21 +/- 0.03 | 0.03 +/- 0.00 | 7.54 +/- 0.96 |
| 4542 | 758 | DKLLFTVTIEKWK | 495 | 0.39 +/- 0.03 | 0.07 +/- 0.00 | 5.34 +/- 0.80 |
| 4543 | 759 | DKLLFTVTIEKYK | 496 | 0.45 +/- 0.04 | 0.09 +/- 0.06 | 7.01 +/- 4.69 |
| 4621 | 821 | DKLLFTVTIEK | 507 | 0.21 +/- 0.00 | 0.10 +/- 0.11 | 5.94 +/- 6.30 |

FIG. 122B

| FKBP construct | | | | FRB_86 + FKBP_SmTrip9 | | | FRB_229 + FKBP_SmTrip9 | | |
|---|---|---|---|---|---|---|---|---|---|
| ATG# | Pep ID | Pep Sequence | SEQ ID NO. | With Rap | No Rap | Response | With Rap | No Rap | Response |
| 3770 | 245 | GSMLFRVTINS | 288 | 0.37 +/- 0.01 | 0.09 +/- 0.01 | 3.90 +/- 0.45 | 0.22 +/- 0.01 | 0.04 +/- 0.01 | 5.39 +/- 0.64 |
| 3937 | 521 | GKMLFRVTINSWK | 827 | 0.77 +/- 0.02 | 0.52 +/- 0.08 | 1.49 +/- 0.19 | 0.64 +/- 0.06 | 0.29 +/- 0.02 | 2.22 +/- 0.08 |
| 4455 | 780 | GKMLFRVTINS | 501 | 0.45 +/- 0.02 | 0.20 +/- 0.02 | 2.27 +/- 0.16 | 0.31 +/- 0.01 | 0.08 +/- 0.00 | 3.75 +/- 0.02 |
| 4416 | 745 | DKMLFTVTIQKWK | 478 | 0.56 +/- 0.01 | 0.09 +/- 0.04 | 6.94 +/- 3.13 | 0.53 +/- 0.11 | 0.06 +/- 0.04 | 10.92 +/- 4.89 |
| 4456 | 765 | DKMLFTVTIQK | 502 | 0.36 +/- 0.06 | 0.03 +/- 0.00 | 12.46 +/- 3.06 | 0.25 +/- 0.05 | 0.02 +/- 0.00 | 15.12 +/- 0.57 |
| 4415 | 744 | DKMLFKVTIQKWK | 477 | 0.56 +/- 0.03 | 0.12 +/- 0.05 | 5.19 +/- 2.29 | 0.41 +/- 0.02 | 0.06 +/- 0.01 | 6.88 +/- 0.65 |
| 4436 | 779 | DKMLFKVTIQK | 503 | 0.43 +/- 0.01 | 0.06 +/- 0.01 | 6.95 +/- 0.73 | 0.24 +/- 0.00 | 0.03 +/- 0.00 | 7.49 +/- 0.81 |
| 4544 | 793 | DKLLFTVTIGKWK | 497 | 0.48 +/- 0.01 | 0.07 +/- 0.03 | 7.10 +/- 3.14 | 0.42 +/- 0.03 | 0.04 +/- 0.02 | 12.75 +/- 6.40 |
| 4618 | 820 | DKLLFTVTIGK | 504 | 0.22 +/- 0.01 | 0.02 +/- 0.00 | 11.31 +/- 1.60 | 0.17 +/- 0.04 | 0.01 +/- 0.00 | 14.91 +/- 1.83 |
| 4422 | 749 | DKMLFTVTIGKWK | 484 | 0.58 +/- 0.01 | 0.07 +/- 0.04 | 9.94 +/- 4.88 | 0.47 +/- 0.01 | 0.03 +/- 0.00 | 16.98 +/- 0.78 |
| 4619 | 819 | DKMLFTVTIGK | 505 | 0.27 +/- 0.03 | 0.03 +/- 0.00 | 8.91 +/- 0.28 | 0.18 +/- 0.01 | 0.02 +/- 0.00 | 12.57 +/- 2.66 |
| 4461 | 753 | DKMLFTVTIEKWK | 490 | 0.43 +/- 0.03 | 0.07 +/- 0.03 | 6.47 +/- 1.99 | 0.43 +/- 0.01 | 0.05 +/- 0.03 | 11.88 +/- 6.85 |
| 4620 | 822 | DKMLFTVTIEK | 506 | 0.18 +/- 0.02 | 0.02 +/- 0.01 | 10.41 +/- 1.84 | 0.14 +/- 0.01 | 0.01 +/- 0.00 | 14.54 +/- 0.17 |
| 4542 | 758 | DKLLFTVTIEKWK | 495 | 0.39 +/- 0.09 | 0.06 +/- 0.02 | 7.91 +/- 4.43 | 0.36 +/- 0.03 | 0.03 +/- 0.00 | 13.82 +/- 0.02 |
| 4543 | 759 | DKLLFTVTIEKYK | 496 | 0.44 +/- 0.00 | 0.06 +/- 0.02 | 7.60 +/- 2.22 | 0.35 +/- 0.03 | 0.03 +/- 0.00 | 13.69 +/- 0.63 |
| 4621 | 821 | DKLLFTVTIEK | 507 | 0.19 +/- 0.00 | 0.03 +/- 0.01 | 7.30 +/- 2.11 | 0.17 +/- 0.01 | 0.02 +/- 0.01 | 11.52 +/- 5.27 |

FIG. 123

| Biochemical analysis of synthetic SmTrip9 variants ||||||
|---|---|---|---|---|---|
| Pep ID | Sequence | SEQ ID NO. | SmTrip9 Kd (uM) | VS-HiBiT Kd (uM) | Bmax (RLU) |
| 521 | *GKMLFRVTINSWK | 827 | 0.06 | 1.21 | 3.25E+07 |
| 627 | *DKMLFRVTINSWK | 508 | 0.29 | 11.76 | 1.29E+07 |
| 628 | *EKMLFRVTINSWK | 509 | 0.10 | 0.76 | 2.80E+07 |
| 629 | *RKMLFRVTINSWK | 510 | 0.02 | 1.23 | 2.99E+07 |
| 630 | *KKMLFRVTINSWK | 511 | 0.02 | 1.64 | 2.98E+07 |
| 631 | *HKMLFRVTINSWK | 512 | 0.03 | ND | 2.65E+07 |
| 632 | *GLMLFRVTINSWK | 513 | 0.08 | ND | 1.20E+07 |
| 633 | *GQMLFRVTINSWK | 514 | 0.09 | ND | 1.88E+07 |
| 634 | *GTMLFRVTINSWK | 515 | 0.08 | ND | 1.27E+07 |
| 635 | *GKLLFRVTINSWK | 516 | 0.06 | 1.54 | 2.81E+07 |
| 636 | *GKMLFKVTINSWK | 517 | 0.17 | 2.10 | 3.10E+07 |
| 637 | *GKMLFRVTIQSWK | 518 | 0.02 | 1.78 | 3.13E+07 |
| 638 | *GKMLFRVTIDSWK | 519 | 0.26 | 0.96 | 2.95E+07 |
| 639 | *GKMLFRVTIGSWK | 520 | 0.07 | 1.71 | 2.88E+07 |
| 640 | *GKMLFRVTINTWK | 521 | 0.13 | ND | 2.91E+07 |
| 641 | *GKMLFRVTINNWK | 522 | 0.24 | ND | 2.87E+07 |
| 642 | *GKMLFRVTINQWK | 523 | 0.14 | ND | 2.62E+07 |
| 643 | *GKMLFRVTINPWK | 524 | 0.08 | ND | 3.00E+07 |
| 644 | *GKMLFRVTINKWK | 525 | 0.09 | ND | 3.05E+07 |
| 645 | *GKMLFRVTINSWQ | 526 | 0.26 | ND | 4.96E+06 |
| 646 | *GKMLFRVTINSWN | 527 | 1.46 | ND | 8.61E+06 |
| 647 | *GKMLFRVTINSWT | 528 | 0.18 | ND | 2.47E+07 |
| 648 | *GKMLFRVTINSWH | 529 | 0.19 | ND | 2.64E+07 |
| 649 | *GKMLFRVTINSWP | 530 | 0.08 | ND | 2.97E+07 |
| 650 | *GKMLFRVTINSWR | 531 | 0.09 | ND | 2.53E+07 |
| *Terminus unblocked ND = Not Determined ||||||

FIG. 124

Biochemical analysis of synthetic SmTrip9 variants

| Pep ID | Sequence | SEQ ID NO. | SmTrip9 Kd (uM) | VS-HiBiT Kd (uM) | Bmax (RLU) |
|---|---|---|---|---|---|
| 521 | GKMLFRVTINSWK | 827 | 0.18 | 2.11 | 2.25E+07 |
| 677 | GKMKFRVTIDSWK | 532 | 1.47 | 1.41 | 3.16E+07 |
| 678 | GKMLFRVKINSWK | 467 | 0.74 | 1.14 | 3.01E+07 |
| 679 | GKMLFRVRINSWK | 468 | 0.36 | 1.13 | 2.86E+07 |
| 680 | GKMLFRVEINSWK | 533 | 30.23 | ND | 3.72E+07 |
| 681 | GKMLFRVDINSWK | 469 | 3.21 | ND | 4.74E+06 |
| 682 | GKMLFRVQINSWK | 534 | 0.64 | ND | 1.91E+07 |
| 683 | GKMKFRVKINSWK | 535 | 6.72 | ND | 2.38E+07 |
| 684 | GKMKFRVRINSWK | 536 | 2.23 | ND | 2.09E+07 |
| 685 | GKMKFRVEINSWK | 537 | 8.63 | ND | 3.62E+07 |
| 686 | GKMKFRVDINSWK | 538 | 26.76 | ND | 2.62E+07 |
| 687 | GKMKFRVQINSWK | 539 | 2.52 | ND | 2.81E+07 |
| 688 | GKMKFRVNINSWK | 540 | 9.04 | ND | 2.65E+07 |
| 689 | GKMKFRVSINSWK | 541 | 2.97 | ND | 3.11E+07 |
| 690 | GKMKFRVTINSWK | 466 | 0.68 | 1.59 | 3.21E+07 |
| ND = Not Determined | | | | | |

FIG. 125

Biochemical analysis of synthetic SmTrip9 variants

| Pep ID | Sequence | SEQ ID NO. | SmTrip9 Kd (uM) | VS-HiBiT Kd (uM) | Bmax (RLU) |
|---|---|---|---|---|---|
| 521 | GKMLFRVTINSWK | 827 | 0.51 | ND | 2.58E+07 |
| 613 | GKMLFRVNINSWK | 542 | 5.25 | ND | 3.23E+07 |
| 614 | GKMLFRVSINSWK | 543 | 2.58 | ND | 3.66E+07 |
| 615 | GKMLFRVWINSWK | 544 | 0.35 | ND | 1.75E+07 |
| 616 | GKMSFRVTINSWK | 545 | 1.23 | ND | 2.31E+07 |
| 617 | GKMWFRVTINSWK | 546 | 0.32 | ND | 1.20E+07 |
| 618 | GKMNFRVTINSWK | 547 | 2.69 | ND | 1.10E+07 |
| 619 | GSMLFRVTINSYK | 548 | 1.51 | ND | 2.57E+07 |
| 620 | GKMLFRVTINSYK | 549 | 0.19 | ND | 2.66E+07 |
| 621 | GKMLFRVTIKSWK | 550 | 0.04 | 1.12 | 3.11E+07 |
| 622 | GKMLFRVTIESWK | 551 | 7.24 | 33.48 | 3.41E+07 |
| 716 | GKMKFRVTIQSWK | 552 | 0.29 | ND | 3.36E+07 |
| 717 | GKMKFRVTIESWK | 553 | 1.14 | ND | 3.26E+07 |
| 718 | GKMKFRVTIKSWK | 554 | 0.38 | ND | 3.36E+07 |
| 719 | GKMKFRVTIRSWK | 555 | 0.37 | ND | 3.27E+07 |
| ND = Not Determined | | | | | |

FIG. 126

| \multicolumn{5}{c}{Biochemical analysis of synthetic SmTrip9 variants} |||||
|---|---|---|---|---|
| Pep ID | Sequence | SEQ ID NO. | SmTrip9 Kd (uM) | VS-HiBiT Kd (uM) | Bmax (RLU) |

| Pep ID | Sequence | SEQ ID NO. | SmTrip9 Kd (uM) | VS-HiBiT Kd (uM) | Bmax (RLU) |
|---|---|---|---|---|---|
| 521 | GKMLFRVTINSWK | 827 | 0.17 | 4.20 | 2.51E+07 |
| 651 | RLMLFRVTINSWK | 556 | 0.04 | ND | 2.27E+07 |
| 652 | RQMLFRVTINSWK | 557 | 0.03 | ND | 2.86E+07 |
| 653 | KLMLFRVTINSWK | 558 | 0.16 | ND | 2.78E+07 |
| 654 | KQMLFRVTINSWK | 559 | 0.06 | ND | 2.86E+07 |
| 655 | ELMLFRVTINSWK | 560 | 15.86 | ND | 7.15E+06 |
| 656 | EQMLFRVTINSWK | 463 | 6.26 | ND | 1.52E+07 |
| 657 | DLMLFRVTINSWK | 561 | 0.07 | ND | 6.26E+05 |
| 658 | DQMLFRVTINSWK | 562 | 4.38 | ND | 2.38E+06 |
| 659 | DKMLFRVTINSWK | 563 | 0.58 | 31.91 | 3.65E+06 |
| 660 | EKMLFRVTINSWK | 564 | 0.19 | 9.75 | 1.83E+07 |
| 661 | RKMLFRVTINSWK | 565 | 0.01 | 4.34 | 3.19E+07 |
| 662 | KKMLFRVTINSWK | 566 | 0.02 | 2.72 | 3.09E+07 |
| 663 | GKMLFRVTIDSWK | 470 | 0.25 | 2.40 | 3.21E+07 |
| 665 | GKMLFRVTIGSWK | 567 | 0.14 | 6.16 | 2.81E+07 |
| 667 | GKMLFRVTINKWK | 568 | 0.07 | 2.98 | 3.63E+07 |
| 668 | GKMLFRVTIGKWK | 392 | 0.06 | 2.78 | 3.06E+07 |
| 669 | GKMLFRVTIGNWK | 394 | 0.38 | 3.06 | 2.82E+07 |
| 670 | GKMLFRVTISKWK | 569 | 0.03 | 3.96 | 3.11E+07 |
| 671 | GKMLFRVTIQKWK | 570 | 0.02 | 3.15 | 3.67E+07 |
| 672 | GKMLFRVTITKWK | 571 | 0.01 | 3.19 | 3.18E+07 |
| 673 | GKMLFRVTIKKWK | 572 | 0.04 | 2.85 | 3.53E+07 |
| 675 | GKMLFKVTINSWK | 573 | 0.17 | 8.06 | 2.61E+07 |
| 676 | RLMLFRVTIGKWK | 574 | 0.02 | 4.09 | 2.92E+07 |
| \multicolumn{6}{c}{ND = Not Determined} ||||||

FIG. 127

| Biochemical analysis of synthetic SmTrip9 variants | | | | | |
|---|---|---|---|---|---|
| Pep ID | Sequence | SEQ ID NO. | SmTrip9 Kd (uM) | VS-HiBiT Kd (uM) | Bmax (RLU) |
| 521 | GKMLFRVTINSWK | 827 | 0.21 | 2.18 | 2.82E+07 |
| 659 | DKMLFRVTINSWK | 563 | 0.76 | 24.39 | 5.24E+06 |
| 660 | EKMLFRVTINSWK | 564 | 0.30 | 4.38 | 2.35E+07 |
| 667 | GKMLFRVTINKWK | 568 | 0.16 | 0.79 | 4.07E+07 |
| 668 | GKMLFRVTIGKWK | 392 | 0.13 | 0.75 | 3.55E+07 |
| 671 | GKMLFRVTIQKWK | 570 | 0.06 | 0.65 | 4.21E+07 |
| 675 | GKMLFKVTINSWK | 573 | 0.47 | 9.71 | 1.65E+07 |
| 620 | GKMLFRVTINSYK | 549 | 0.12 | 2.27 | 2.82E+07 |
| 622 | GKMLFRVTIESWK | 551 | 2.88 | 1.73 | 3.16E+07 |
| 701 | GKMLFRVTINRWK | 575 | 0.12 | 1.01 | 3.69E+07 |
| 703 | GKMLFRVTIEKWK | 397 | 0.11 | 1.18 | 3.61E+07 |
| 707 | EKMLFRVTIEKWK | 442 | 1.12 | 0.90 | 3.23E+07 |
| 708 | EKMLFRVTIGKWK | 411 | 0.28 | 1.18 | 3.27E+07 |
| 709 | EKMLFRVTIGRWK | 412 | 0.18 | 1.61 | 2.99E+07 |
| 710 | EKMLFTVTIGKWK | 576 | 1.29 | 5.24 | 1.94E+07 |
| 711 | EKLLFTVTIGKWK | 577 | 0.50 | 5.52 | 1.40E+07 |
| 712 | EKMLFTVTIGRWK | 578 | 0.37 | 6.09 | 1.66E+07 |
| 714 | EKMLFKVTIQKWK | 472 | 0.22 | 1.18 | 3.34E+07 |
| 720 | EKMLFTVTIEKWK | 579 | 0.36 | 4.29 | 2.19E+07 |
| 722 | DKMLFRVTIESWK | 580 | 17.79 | 10.61 | 2.23E+07 |
| 726 | EKLLFRVTIGKYK | 581 | 0.64 | 1.49 | 2.63E+07 |
| ND = Not Determined | | | | | |

FIG. 128

| | Biochemical analysis of synthetic SmTrip9 variants | | | | |
|---|---|---|---|---|---|
| Pep ID | Sequence | SEQ ID NO. | SmTrip9 Kd (uM) | VS-HiBiT Kd (uM) | Bmax (RLU) |
| 521 | GKMLFRVTINSWK | 827 | 0.20 | 3.56 | 3.03E+07 |
| 738 | DKMLFRVTIQKWK | 400 | 0.23 | 3.06 | 3.64E+07 |
| 739 | DKMLFRVTIGKWK | 401 | 0.20 | 2.28 | 3.41E+07 |
| 740 | DKMLFRVTIGNWK | 403 | 3.65 | 59.23 | 1.93E+07 |
| 741 | DKMLFRVTIQNWK | 404 | 12.58 | 33.67 | 1.01E+07 |
| 742 | DKMLFRVTIEKWK | 406 | 0.75 | 1.44 | 3.55E+07 |
| 743 | GKMLFRVTINKWK | 471 | 0.10 | 1.33 | 3.98E+07 |
| 744 | DKMLFKVTIQKWK | 477 | 1.13 | 4.65 | 2.74E+07 |
| 745 | DKMLFTVTIQKWK | 478 | 0.16 | 7.52 | 2.30E+07 |
| 746 | DKLLFKVTIQKWK | 582 | 1.10 | 6.23 | 1.53E+07 |
| 747 | DKLLFKVTIQKYK | 583 | 0.10 | 4.25 | 2.76E+07 |
| 748 | DKMLFKVTIGKWK | 483 | 0.44 | 2.24 | 3.43E+07 |
| 749 | DKMLFTVTIGKWK | 484 | 1.70 | 8.26 | 1.92E+07 |
| 750 | DKLLFKVTIGKWK | 491 | 0.35 | 3.34 | 2.32E+07 |
| 751 | DKLLFKVTIGKYK | 584 | 0.61 | 3.28 | 2.55E+07 |
| 752 | DKMLFKVTIEKWK | 489 | 0.32 | 1.58 | 3.26E+07 |
| 753 | DKMLFTVTIEKWK | 490 | 0.12 | 7.59 | 2.01E+07 |
| 754 | DKLLFKVTIEKWK | 585 | 0.75 | 1.52 | 2.35E+07 |
| 755 | DKLLFKVTIEKYK | 586 | 1.45 | 1.20 | 2.70E+07 |
| | ND = Not Determined | | | | |

FIG. 129

| Biochemical analysis of synthetic SmTrip9 variants | | | | | |
|---|---|---|---|---|---|
| Pep ID | Sequence | SEQ ID NO. | SmTrip9 Kd (uM) | VS-HiBiT Kd (uM) | Bmax (RLU) |
| 521 | GKMLFRVTINSWK | 827 | 0.32 | 2.34 | 2.74E+07 |
| 756 | DKLLFTVTIQKWK | 493 | 0.48 | 4.26 | 1.73E+07 |
| 757 | DKLLFTVTIQKYK | 494 | 0.36 | 3.67 | 1.91E+07 |
| 758 | DKLLFTVTIEKWK | 495 | 0.19 | 6.34 | 1.84E+07 |
| 759 | DKLLFTVTIEKYK | 496 | 0.33 | 4.93 | 2.25E+07 |
| 760 | KKMLFRVTIQKWK | 445 | 0.00 | 1.61 | 4.48E+07 |
| 761 | KKLLFRVTIQKWK | 587 | 0.02 | 1.49 | 4.00E+07 |
| 762 | DRMLFRVTIQRWR | 588 | 0.12 | 2.83 | 3.45E+07 |
| 766 | ERMLFRVTIGRWR | 589 | 0.07 | 6.49 | 2.86E+07 |
| 768 | GRMLFRVTINRWR | 590 | 0.10 | 1.96 | 3.97E+07 |
| 770 | DRMLFRVTIERWR | 591 | 0.35 | 3.74 | 2.53E+07 |
| 738 | DKMLFRVTIQKWK | 400 | 0.11 | 2.37 | 3.97E+07 |
| 742 | DKMLFRVTIEKWK | 406 | 1.00 | 0.68 | 3.89E+07 |
| 743 | GKMLFRVTINKWK | 471 | 0.10 | 1.36 | 4.36E+07 |
| 745 | DKMLFTVTIQKWK | 478 | 0.20 | 5.84 | 2.46E+07 |
| 753 | DKMLFTVTIEKWK | 490 | 0.15 | 4.73 | 2.16E+07 |
| ND = Not Determined | | | | | |

FIG. 130

| Biochemical analysis of synthetic SmTrip9 variants | | | | | |
|---|---|---|---|---|---|
| Pep ID | Sequence | SEQ ID NO. | SmTrip9 Kd (uM) | VS-HiBiT Kd (uM) | Bmax (RLU) |
| 521 | GKMLFRVTINSWK | | 0.48 | 3.95 | 2.43E+07 |
| 756 | DKLLFTVTIQKWK | | 0.95 | 5.52 | 1.43E+07 |
| 757 | DKLLFTVTIQKYK | | 0.19 | 7.02 | 1.87E+07 |
| 758 | DKLLFTVTIEKWK | | 0.52 | 6.82 | 1.45E+07 |
| 759 | DKLLFTVTIEKYK | | 0.56 | 4.94 | 1.87E+07 |
| 760 | KKMLFRVTIQKWK | | 0.02 | 2.45 | 4.25E+07 |
| 781 | GKMLFKVTINKWK | | 0.38 | 1.20 | 4.22E+07 |
| 782 | GKMLFTVTINKWK | | 0.36 | 2.78 | 3.18E+07 |
| 783 | DKMLFKVTIQKYK | | 0.24 | 2.20 | 3.24E+07 |
| 784 | DKMLFRVTINKWK | | 0.41 | 11.60 | 1.67E+07 |
| 785 | DKMLFKVTIEKYK | | 0.38 | 1.28 | 3.64E+07 |
| 786 | DKMLFTVTINKWK | | 0.50 | 35.65 | 2.54E+06 |
| 787 | DKMLFKVTINKWK | | 0.73 | 24.17 | 1.23E+07 |
| 793 | DKLLFTVTIGKWK | | 0.54 | 5.65 | 1.27E+07 |
| 794 | DKLLFTVTIGKYK | | 0.23 | 5.96 | 1.01E+07 |
| 799 | DKLLFTVTINKWK | | 0.21 | 42.69 | 1.51E+06 |
| 800 | DKLLFTVTINKYK | | 9.75 | 88.68 | 6.49E+05 |
| 743 | GKMLFRVTINKWK | | 0.11 | 1.19 | 4.05E+07 |
| 745 | DKMLFTVTIQKWK | | 0.30 | 25.63 | 2.66E+06 |
| 749 | DKMLFTVTIGKWK | | 1.06 | 6.57 | 1.34E+07 |
| ND = Not Determined | | | | | |

FIG. 131A

| Solubility of synthetic SmTrip9 peptides | | | |
|---|---|---|---|
| Pep ID | Sequence | SEQ ID NO. | Solubility# |
| 521 | *GKMLFRVTINSWK | | Y |
| 627 | *DKMLFRVTINSWK | | N |
| 628 | *EKMLFRVTINSWK | | Y |
| 629 | *RKMLFRVTINSWK | | Y |
| 630 | *KKMLFRVTINSWK | | Y |
| 631 | *HKMLFRVTINSWK | | N |
| 632 | *GLMLFRVTINSWK | | N |
| 633 | *GQMLFRVTINSWK | | N |
| 634 | *GTMLFRVTINSWK | | N |
| 635 | *GKLLFRVTINSWK | | Y |
| 636 | *GKMLFKVTINSWK | | Y |
| 637 | *GKMLFRVTIQSWK | | Y |
| 638 | *GKMLFRVTIDSWK | | Y |
| 639 | *GKMLFRVTIGSWK | | Y |
| 640 | *GKMLFRVTINTWK | | Y |
| 641 | *GKMLFRVTINNWK | | Y |
| 642 | *GKMLFRVTINQWK | | Y |
| 643 | *GKMLFRVTINPWK | | Y |
| 644 | *GKMLFRVTINKWK | | Y |
| 645 | *GKMLFRVTINSWQ | | Y |
| 646 | *GKMLFRVTINSWN | | Y |
| 647 | *GKMLFRVTINSWT | | Y |
| 648 | *GKMLFRVTINSWH | | Y |
| 649 | *GKMLFRVTINSWP | | Y |
| 650 | *GKMLFRVTINSWR | | N |
| 677 | GKMKFRVTIDSWK | | Y |
| 678 | GKMLFRVKINSWK | | Y |
| 679 | GKMLFRVRINSWK | | Y |
| 680 | GKMLFRVEINSWK | | Y |
| 681 | GKMLFRVDINSWK | | N |
| 682 | GKMLFRVQINSWK | | Y |
| 683 | GKMKFRVKINSWK | | Y |
| 684 | GKMKFRVRINSWK | | Y |
| 685 | GKMKFRVEINSWK | | Y |
| 686 | GKMKFRVDINSWK | | Y |
| 687 | GKMKFRVQINSWK | | Y |
| 688 | GKMKFRVNINSWK | | Y |
| 689 | GKMKFRVSINSWK | | Y |
| 690 | GKMKFRVTINSWK | | Y |
| #in water at ~1 mM after multiple freeze/thaws *Terminus unblocked | | | |

FIG. 131B

| Solubility of synthetic SmTrip9 peptides | | | |
|---|---|---|---|
| Pep ID | Sequence | SEQ ID NO. | Solubility# |
| 521 | GKMLFRVTINSWK | 827 | Y |
| 613 | GKMLFRVNINSWK | 542 | Y |
| 614 | GKMLFRVSINSWK | 543 | Y |
| 615 | GKMLFRVWINSWK | 544 | Y |
| 616 | GKMSFRVTINSWK | 545 | Y |
| 617 | GKMWFRVTINSWK | 546 | Y |
| 618 | GKMNFRVTINSWK | 547 | Y |
| 619 | GSMLFRVTINSYK | 548 | Y |
| 620 | GKMLFRVTINSYK | 549 | Y |
| 621 | GKMLFRVTIKSWK | 550 | Y |
| 622 | GKMLFRVTIESWK | 551 | Y |
| 716 | GKMKFRVTIQSWK | 552 | Y |
| 717 | GKMKFRVTIESWK | 553 | Y |
| 718 | GKMKFRVTIKSWK | 554 | Y |
| 719 | GKMKFRVTIRSWK | 555 | Y |
| 651 | RLMLFRVTINSWK | 827 | N |
| 652 | RQMLFRVTINSWK | 556 | N |
| 653 | KLMLFRVTINSWK | 557 | N |
| 654 | KQMLFRVTINSWK | 558 | N |
| 655 | ELMLFRVTINSWK | 559 | N |
| 656 | EQMLFRVTINSWK | 560 | N |
| 657 | DLMLFRVTINSWK | 463 | N |
| 658 | DQMLFRVTINSWK | 561 | N |
| 659 | DKMLFRVTINSWK | 562 | N |
| 660 | EKMLFRVTINSWK | 563 | Y |
| 661 | RKMLFRVTINSWK | 564 | Y |
| 662 | KKMLFRVTINSWK | 565 | Y |
| 663 | GKMLFRVTIDSWK | 566 | Y |
| 665 | GKMLFRVTIGSWK | 470 | Y |
| 667 | GKMLFRVTINKWK | 567 | Y |
| 668 | GKMLFRVTIGKWK | 568 | Y |
| 669 | GKMLFRVTIGNWK | 392 | Y |
| 670 | GKMLFRVTISKWK | 394 | Y |
| 671 | GKMLFRVTIQKWK | 569 | Y |
| 672 | GKMLFRVTITKWK | 570 | Y |
| 673 | GKMLFRVTIKKWK | 571 | Y |
| 675 | GKMLFKVTINSWK | 572 | Y |
| 676 | RLMLFRVTIGKWK | 573 | Y |
| 701 | GKMLFRVTINRWK | 575 | Y |
| 703 | GKMLFRVTIEKWK | 397 | Y |
| 707 | EKMLFRVTIEKWK | 442 | Y |
| 708 | EKMLFRVTIGKWK | 411 | Y |
| 709 | EKMLFRVTIGRWK | 412 | Y |
| 710 | EKMLFTVTIGKWK | 576 | Y |
| 711 | EKLLFTVTIGKWK | 577 | Y |
| 712 | EKMLFTVTIGRWK | 578 | Y |
| 714 | EKMLFKVTIQKWK | 472 | Y |
| 720 | EKMLFTVTIEKWK | 579 | Y |
| 722 | DKMLFRVTIESWK | 580 | Y |
| 726 | EKLLFRVTIGKYK | 581 | Y |
| #in water at ~1 mM after multiple freeze/thaws *Terminus unblocked | | | |

FIG. 131C

| Solubility of synthetic SmTrip9 peptides ||||
|---|---|---|---|
| Pep ID | Sequence | SEQ ID NO. | Solubility# |
| 521 | GKMLFRVTINSWK | 827 | Y |
| 613 | GKMLFRVNINSWK | 542 | Y |
| 614 | GKMLFRVSINSWK | 543 | Y |
| 615 | GKMLFRVWINSWK | 544 | Y |
| 616 | GKMSFRVTINSWK | 545 | Y |
| 617 | GKMWFRVTINSWK | 546 | Y |
| 618 | GKMNFRVTINSWK | 547 | Y |
| 619 | GSMLFRVTINSYK | 548 | Y |
| 620 | GKMLFRVTINSYK | 549 | Y |
| 621 | GKMLFRVTIKSWK | 550 | Y |
| 622 | GKMLFRVTIESWK | 551 | Y |
| 716 | GKMKFRVTIQSWK | 552 | Y |
| 717 | GKMKFRVTIESWK | 553 | Y |
| 718 | GKMKFRVTIKSWK | 554 | Y |
| 719 | GKMKFRVTIRSWK | 555 | Y |
| 651 | RLMLFRVTINSWK | 827 | N |
| 652 | RQMLFRVTINSWK | 556 | N |
| 653 | KLMLFRVTINSWK | 557 | N |
| 654 | KQMLFRVTINSWK | 558 | N |
| 655 | ELMLFRVTINSWK | 559 | N |
| 656 | EQMLFRVTINSWK | 560 | N |
| 657 | DLMLFRVTINSWK | 463 | N |
| 658 | DQMLFRVTINSWK | 561 | N |
| 659 | DKMLFRVTINSWK | 562 | N |
| 660 | EKMLFRVTINSWK | 563 | Y |
| 661 | RKMLFRVTINSWK | 564 | Y |
| 662 | KKMLFRVTINSWK | 565 | Y |
| 663 | GKMLFRVTIDSWK | 566 | Y |
| 665 | GKMLFRVTIGSWK | 470 | Y |
| 667 | GKMLFRVTINKWK | 567 | Y |
| 668 | GKMLFRVTIGKWK | 568 | Y |
| 669 | GKMLFRVTIGNWK | 392 | Y |
| 670 | GKMLFRVTISKWK | 394 | Y |
| 671 | GKMLFRVTIQKWK | 569 | Y |
| 672 | GKMLFRVTITKWK | 570 | Y |
| 673 | GKMLFRVTIKKWK | 571 | Y |
| 675 | GKMLFKVTINSWK | 572 | Y |
| 676 | RLMLFRVTIGKWK | 573 | Y |
| 701 | GKMLFRVTINRWK | 575 | Y |
| 703 | GKMLFRVTIEKWK | 397 | Y |
| 707 | EKMLFRVTIEKWK | 442 | Y |
| 708 | EKMLFRVTIGKWK | 411 | Y |
| 709 | EKMLFRVTIGRWK | 412 | Y |
| 710 | EKMLFTVTIGKWK | 576 | Y |
| 711 | EKLLFTVTIGKWK | 577 | Y |
| 712 | EKMLFTVTIGRWK | 578 | Y |
| 714 | EKMLFKVTIQKWK | 472 | Y |
| 720 | EKMLFTVTIEKWK | 579 | Y |
| 722 | DKMLFRVTIESWK | 580 | Y |
| 726 | EKLLFRVTIGKYK | 581 | Y |
| #in water at ~1 mM after multiple freeze/thaws<br>*Terminus unblocked ||||

Compare activity of various peptide com

FIG. 139B

| peptide ID | Bmax | Kd |
|---|---|---|
| 263 | 1.00 | 1.0 |
| 592 | 1.00 | 10.3 |
| 595 | 0.68 | 4.8 |
| 603 | 0.06 | 2.7 |
| 604 | 0.93 | 0.9 |
| 605 | 0.92 | 1.7 |
| 606 | 0.94 | 4.0 |
| 607 | 1.14 | 1.7 |
| 593 | 0.78 | 8.2 |
| 594 | 0.40 | 9.9 |
| 598 | 1.08 | 15.4 |
| 599 | 0.68 | 10.5 |
| 600 | 0.52 | 7.2 |
| 602 | 0.89 | 8.9 |
| 591 | 0.11 | 3.8 |
| 596 | 0.29 | 55.9 |
| 597 | 0.05 | 7.5 |
| 601 | 0.10 | 4.1 |
| 609 | 0.42 | 371.7 |
| 610 | 0.12 | 46.2 |

| peptide ID | Bmax | Kd |
|---|---|---|
| 263 | 3.01E+07 | 11.59 |
| 592 | 3.00E+07 | 119.1 |
| 595 | 2.06E+07 | 56.02 |
| 603 | 1.76E+06 | 31.17 |
| 604 | 2.78E+07 | 10.05 |
| 605 | 2.76E+07 | 19.61 |
| 606 | 2.83E+07 | 46.39 |
| 607 | 3.42E+07 | 20.18 |
| 593 | 2.34E+07 | 95.48 |
| 594 | 1.19E+07 | 115 |
| 598 | 3.24E+07 | 178.1 |
| 599 | 2.05E+07 | 122.1 |
| 600 | 1.56E+07 | 83.39 |
| 602 | 2.67E+07 | 103.2 |
| 591 | 3.44E+06 | 44.5 |
| 596 | 8.79E+06 | 648.3 |
| 597 | 1.59E+06 | 86.75 |
| 601 | 3.12E+06 | 47.6 |
| 609 | 1.26E+07 | 4308 |
| 610 | 3.60E+06 | 535.8 |

FIG. 157B

| Clone | Mutations | Kd (normalized) | Bmax (normalized) |
|---|---|---|---|
| LgBiT | | 1 | 1 |
| ATG-2724 | I44M | 3 | 0.57 |
| ATG-3901 | I44M+E11K | 16 | 0.53 |
| ATG-3945 | I44M+E11K+G134D+N135V | 44 | 0.23 |
| ATG-3984 | I44M+E11K+G134D+N135V+L150S | 1958 | 0.12 |
| ATG-4147 | I44M+E11K+L150S | 613 | 0.26 |
| ATG-4166 | I44M+E11K+N135V+L150S | 1296 | 0.12 |

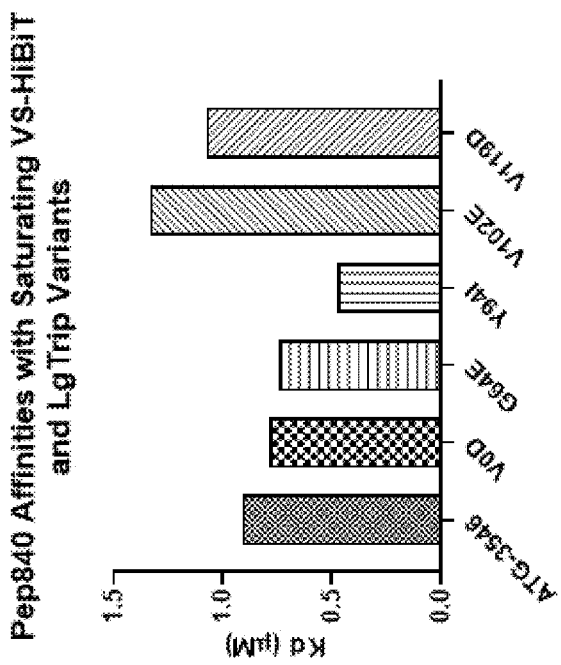
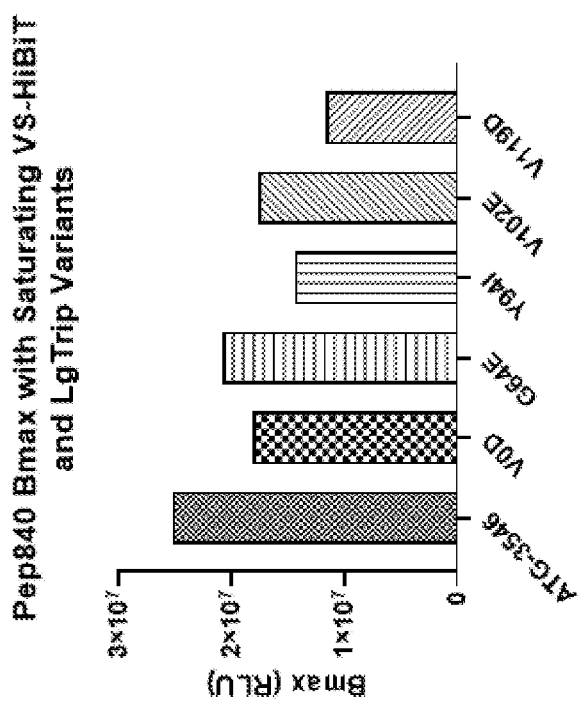
FIG. 176

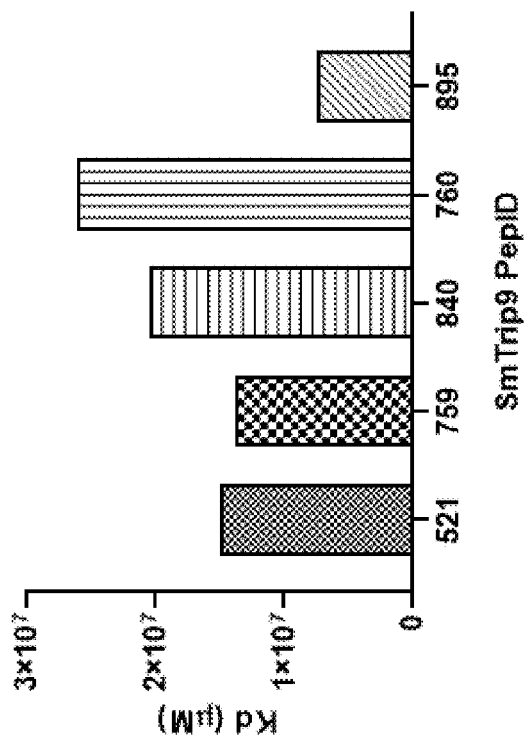
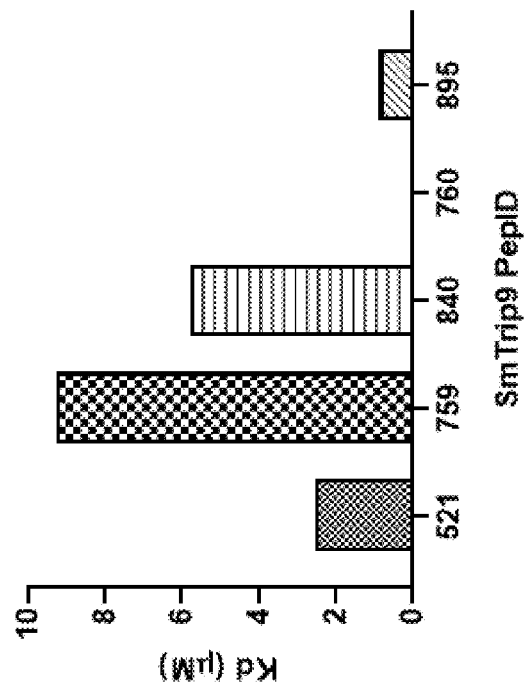
FIG. 177

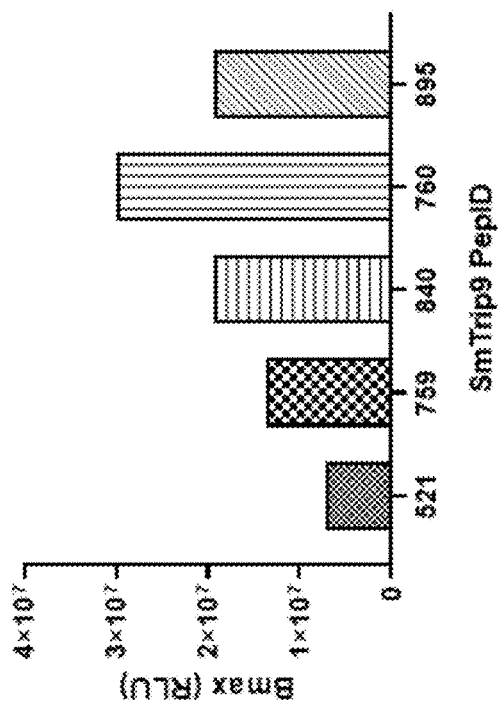
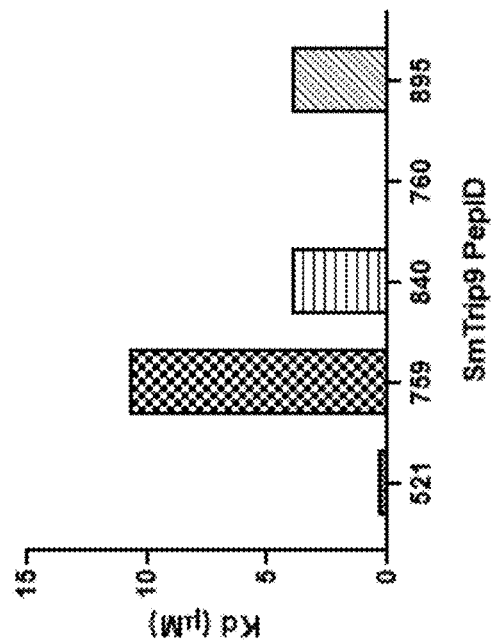
FIG. 178

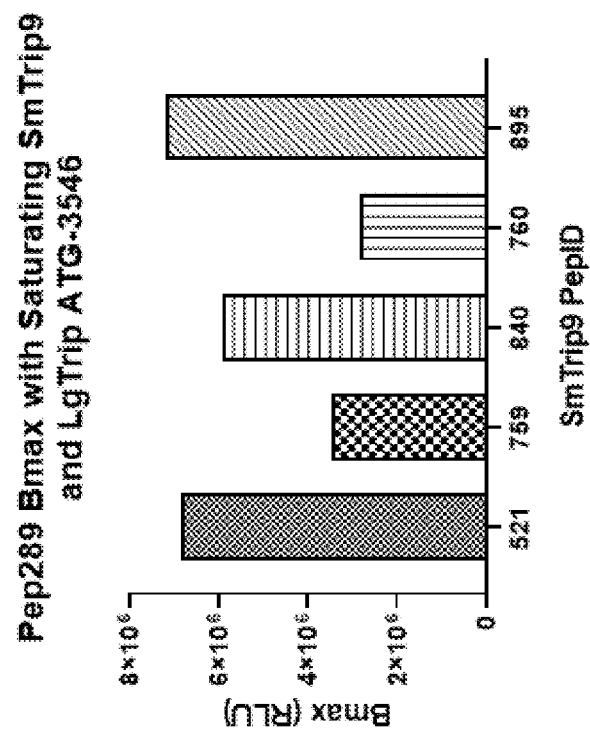
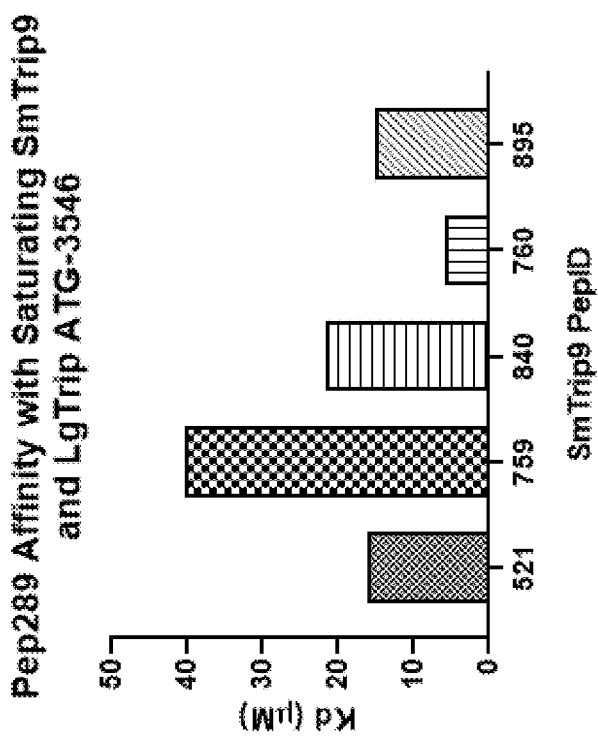
FIG. 179

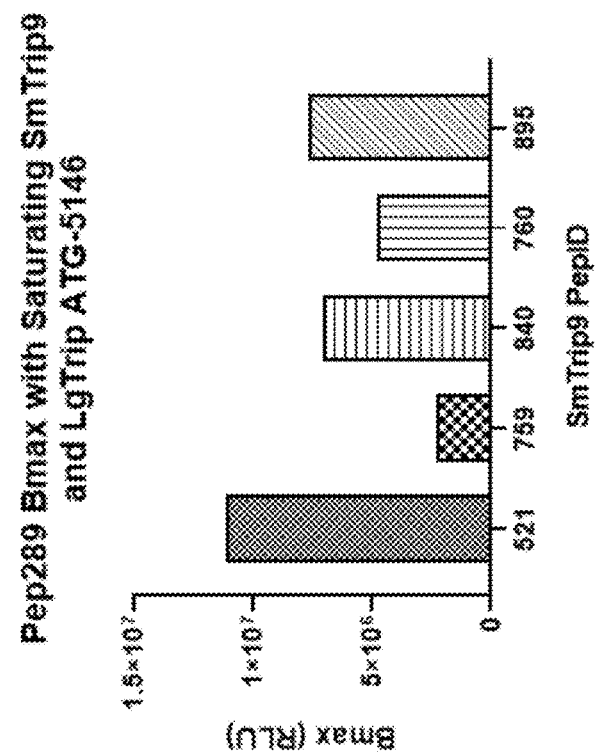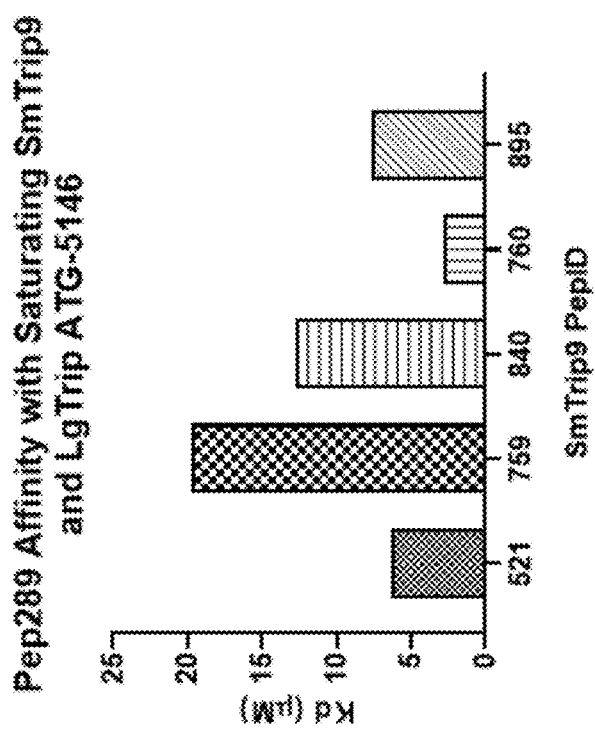
FIG. 180

FIG. 192A-C

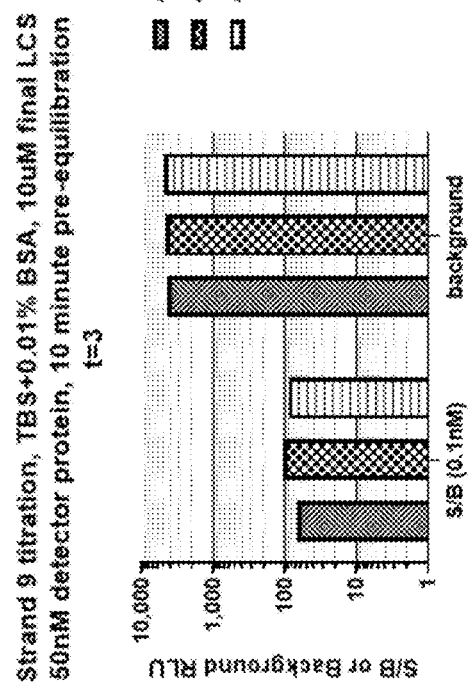
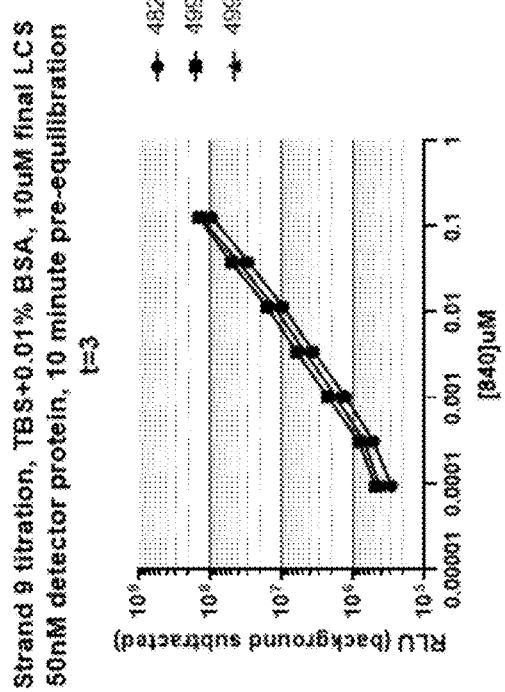
FIG. 201

FIG. 215
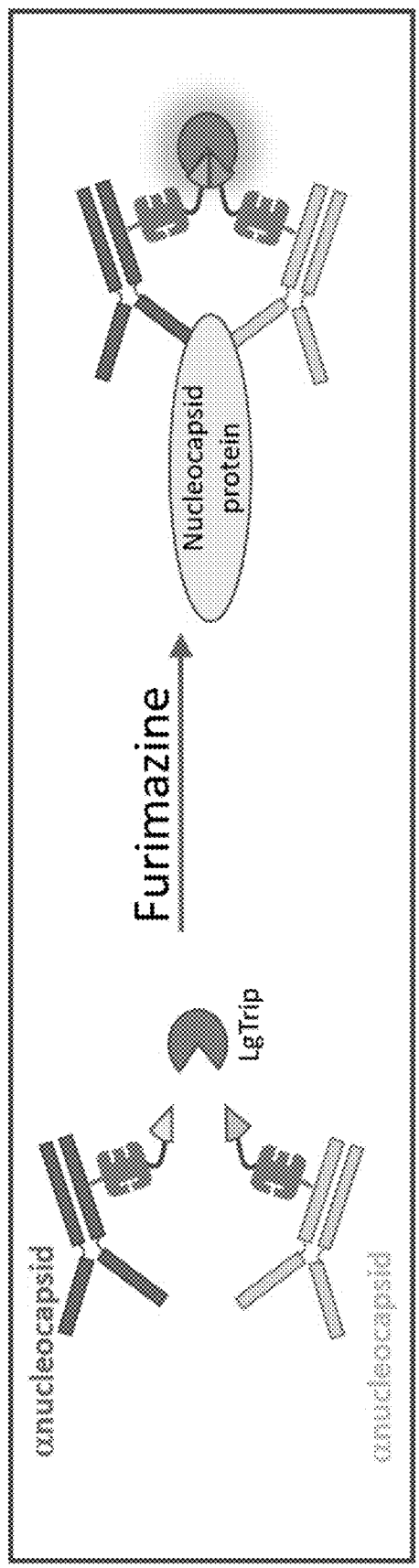
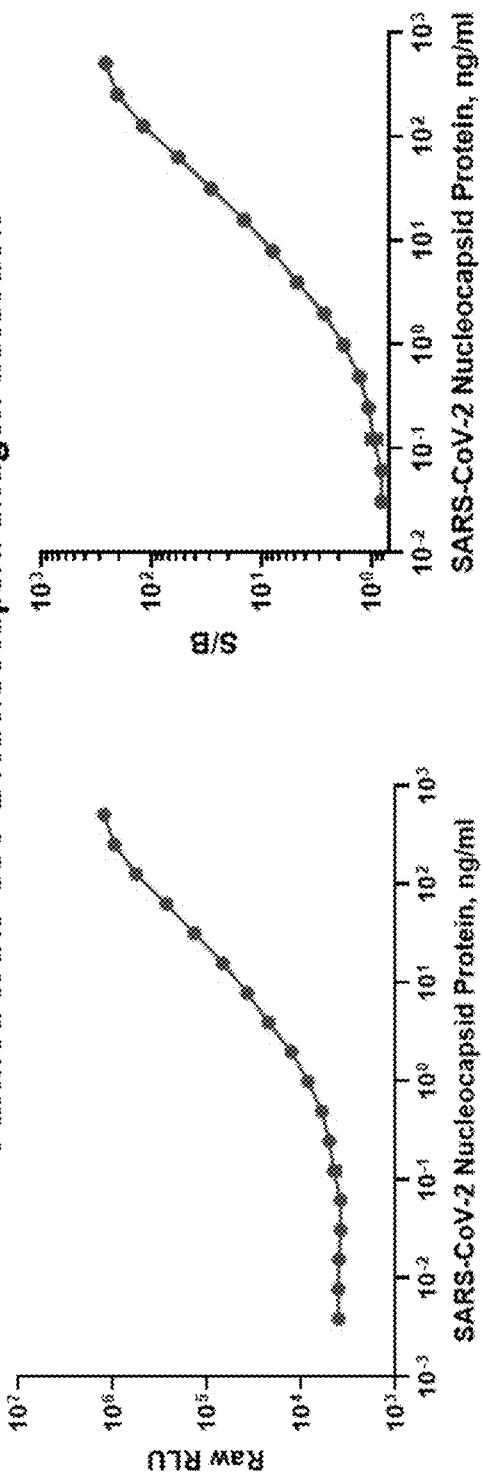

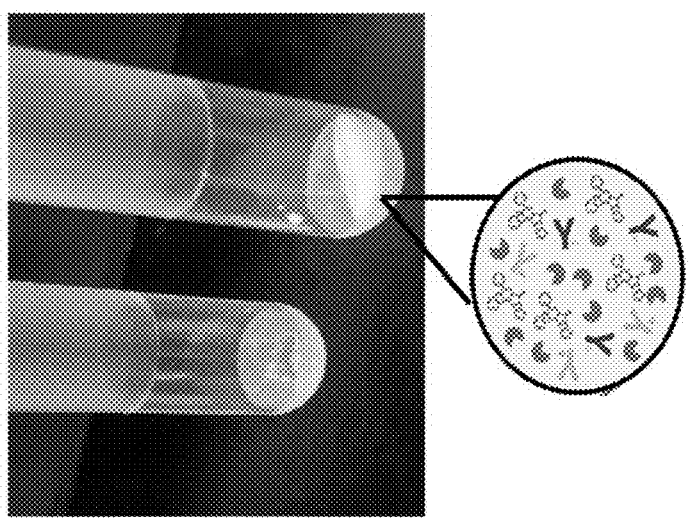
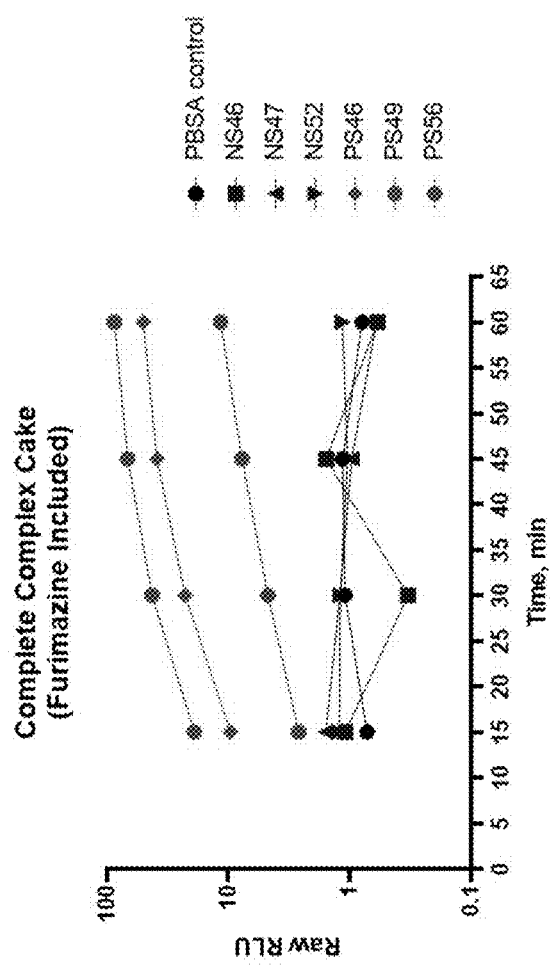
FIG. 216

FIG. 225
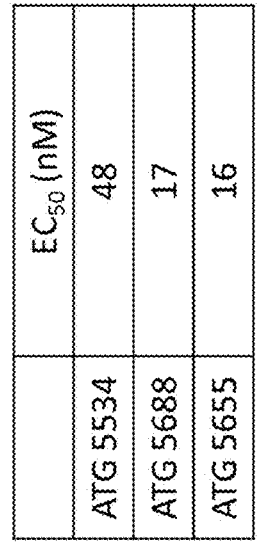
| | EC$_{50}$ (nM) |
|---|---|
| ATG 5534 | 48 |
| ATG 5688 | 17 |
| ATG 5655 | 16 |
Under PMA stimulus, PKCα translocates from cytosol to plasma member in a dose dependent manner
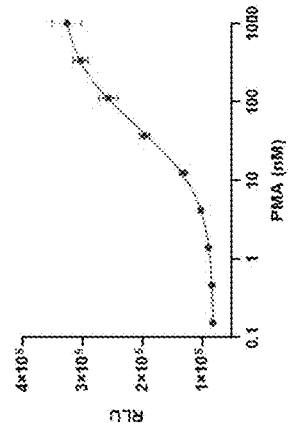
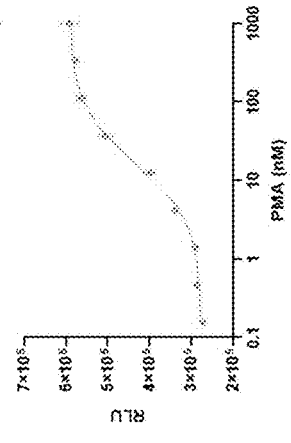
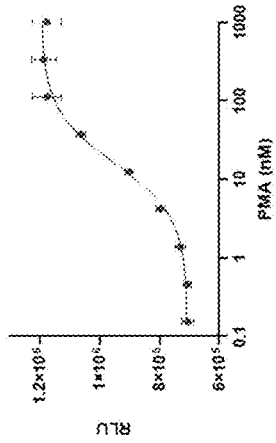

MULTIPARTITE LUCIFERASE PEPTIDES AND POLYPEPTIDES

CROSS-REFERENCE TO RELATED APPLICATION

The present application claims priority to U.S. Provisional Patent Application Ser. No. 62/941,255 filed Nov. 27, 2019, which is hereby incorporated by reference in its entirety.

FIELD

Provided herein are bioluminescent polypeptides and compositions and methods for the assembly of tripartite or multipartite bioluminescent complexes. In particular embodiments, a bioluminescent complex is formed upon the interaction of three or more peptide and/or polypeptide components.

BACKGROUND

Biological processes and analyte detection rely on the co-localization and interactions between molecules, macromolecules, and molecular complexes. In order to understand such processes, and to develop techniques and compounds to manipulate them for research, clinical, and other practical applications, it is necessary to have tools available to detect and monitor these co-localizations/interactions. The study of these interactions, particularly under physiological conditions (e.g., at normal expression levels for monitoring protein interactions) or in complex sample matrices (e.g. blood samples, environmental samples), requires high sensitivity.

SUMMARY

Provided herein are bioluminescent polypeptides and compositions and methods for the assembly of a tripartite or multipartite bioluminescent complex. In particular embodiments, a bioluminescent complex is formed upon the interaction of three or more peptide and/or polypeptide components.

Experiments conducted during development of embodiments herein demonstrate the assembly of a bioluminescent complex, capable of generating luminescence in the presence of an appropriate substrate (e.g., a coelenterazine or a coelenterazine analog substrate), from complementary polypeptide(s) and peptide(s) that collectively span the the length (or >75% of the length, >80% of the length, >85% of the length, >90% of the length, >95% of the length, or more) of a luciferase base sequence (or collectively comprise at least 40% sequence identity to a luciferase base sequence (e.g., >40%, >45%, >50%, >55%, >60%, >65%, >70%, >75%>80%, >85%, >90%, >95%, or more). In some embodiments, "complementary" polyptpide(s) and peptide(s) are separate molecules that each correspond to a portion of a luciferase base sequence. Through structural complementarity, they assemble to form a bioluminescent complex.

Additional experiments were conducted during development of embodiments herein to develop monomeric bioluminescent polypeptides with enhanced characteristics (e.g., stability, luminescence, etc.).

In some embodiments, the complementary polypeptide(s) and peptide(s) are fragments of a luciferase base sequence that assmble to form a bioluminescent complex. In some embodiments, the fragments collectively comprise the full length of the luciferase base sequence. In some embodiments, the fragments collectively comprise at least 75% of the full length of the luciferase base sequence (e.g., >75% of the length, >80% of the length, >85% of the length, >90% of the length, >95% of the length, or more).

In some embodiments, the complementary polypeptide(s) and peptide(s) are variants of portions of a luciferase base sequence individually comprising at least 40% sequence identity to the corresponding portion of the luciferase base sequence (e.g., >40%, >45%, >50%, >55%, >60%, >65%, >70%, >75%>80%, >85%, >90%, >95%, or more) that assmble to form a bioluminescent complex. In some embodiments, the complementary polypeptide(s) and peptide(s) are variants of portions of a luciferase base sequence collectively comprising at least 40% sequence identity to the entire luciferase base sequence (e.g., >40%, >45%, >50%, >55%, >60%, >65%, >70%, >75%>80%, >85%, >90%, >95%, or more) that assemble to form a bioluminescent complex. In some embodiments, the fragments collectively comprise the full length of the luciferase base sequence. In some embodiments, the complementary polypeptide(s) and peptide(s) collectively comprise at least 75% of the full length of the luciferase base sequence (e.g., >75% of the length, >80% of the length, >85% of the length, >90% of the length, >95% of the length, or more).

Examples of luciferase base sequences include SEQ ID NO: 1, SEQ ID NO: 3, SEQ ID NO: 788, and SEQ ID NO: 789. Some embodiments herein provide a polypeptide component that is a fragment of the luciferase base sequence (e.g., SEQ ID NO: 1, SEQ ID NO: 3, SEQ ID NO: 788, and SEQ ID NO: 789) or a variant thereof (e.g., >40%, >45%, >50%, >55%, >60%, >65%, >70%, >75%>80%, >85%, >90%, >95% sequence identity), and one or more complementary peptide(s) and/or polypeptide(s) that collectively span the remainder of the luciferase base sequence. For example, if a luciferase base sequence is 170 amino acid residues in length, an exemplary polypeptide component may be, for example 102, 124, 133, or 148 amino acids in length, and 1, 2, 3, 4, 5, or more complementary peptides correspond to the remaining 68, 46, 37, or 22 amino acids. In some embodiments, each polypeptide component individually comprises at least 40% sequence identity (e.g., >40%, >45%, >50%, >55%, >60%, >65%, >70%, >75%>80%, >85%, >90%, >95%, or more) to the corresponding portion of the luciferase base sequence.

In some embodiments, provided herein are systems or kits comprising comprising: (a) a polypeptide component comprising 40% or greater (e.g., 40%, 45%, 50%, 55%, 60%, 65%, 70%, 75%, 80%, 85%, 90%, 95%, or more) sequence identity to a polypeptide fragment of SEQ ID NO: 788 or SEQ ID NO: 789; and (b) one or more complementary peptides, dipeptides, tripeptides, and/or polypeptides collectively comprising 40% or greater (e.g., 40%, 45%, 50%, 55%, 60%, 65%, 70%, 75%, 80%, 85%, 90%, 95%, or more) sequence identity to the complementary portion of SEQ ID NO: 788 or SEQ ID NO: 789; wherein a bioluminescent signal produced by a bioluminescent complex assembled from the polypeptide component and one or more complementary peptides, dipeptides, tripeptides, and/or polypeptides in the presence of a coelenterazine or a coelenterazine analog substrate is substantially increased when compared to a bioluminescent signal produced by the polypeptide component or one or more complementary peptides, dipeptides, tripeptides, and/or polypeptides and the coelenterazine substrate alone. In some embodiments, the polypeptide component comprises 40% or greater (e.g., 40%, 45%, 50%, 55%, 60%, 65%, 70%, 75%, 80%, 85%, 90%, 95%, or more) sequence identity to SEQ ID NO: 790, and the one or more complementary peptides, dipeptides, tripeptides, and/or polypeptides collectively comprise 40% or greater (e.g., 40%, 45%, 50%, 55%, 60%, 65%, 70%, 75%, 80%, 85%, 90%, 95%, or more) sequence identity to SEQ ID NO: 794. In some embodiments, the polypeptide component comprises 40% or greater (e.g., 40%, 45%, 50%, 55%, 60%, 65%, 70%, 75%, 80%, 85%, 90%, 95%, or more) sequence identity to SEQ ID NO: 791, and the one or more complementary peptides, dipeptides, tripeptides, and/or polypeptides collectively comprise 40% or greater (e.g., 40%,45%, 50%, 55%, 60%, 65%, 70%, 75%, 80%, 85%, 90%, 95%, or more) sequence identity to SEQ ID NO: 795. In some embodiments, the polypeptide component comprises 40% or greater (e.g., 40%, 45%, 50%, 55%, 60%, 65%, 70%, 75%, 80%, 85%, 90%, 95%, or more) sequence identity to SEQ ID NO: 792, and the one or more complementary peptides, dipeptides, tripeptides, and/or polypeptides collectively comprise 40% or greater (e.g., 40%, 45%, 50%, 55%, 60%, 65%, 70%, 75%, 80%, 85%, 90%, 95%, or more) sequence identity to SEQ ID NO: 796. In some embodiments, the polypeptide component comprises 40% or greater (e.g., 40%, 45%, 50%, 55%, 60%, 65%, 70%, 75%, 80%, 85%, 90%, 95%, or more) sequence identity to SEQ ID NO: 793, and the one or more complementary peptides, dipeptides, tripeptides, and/or polypeptides collectively comprise 40% or greater (e.g., 40%, 45%, 50%, 55%, 60%, 65%, 70%, 75%, 80%, 85%, 90%, 95%, or more) sequence identity to SEQ ID NO: 797. In some embodiments, the polypeptide component comprises 40% or greater (e.g., 40%, 45%, 50%, 55%, 60%, 65%, 70%, 75%, 80%, 85%, 90%, 95%, or more) sequence identity to SEQ ID NO: 790, and the one or more complementary peptides, dipeptides, tripeptides, and/or polypeptides collectively comprise 40% or greater (e.g., 40%, 45%, 50%, 55%, 60%, 65%, 70%, 75%, 80%, 85%, 90%, 95%, or more) sequence identity to SEQ ID NO: 798. In some embodiments, the polypeptide component comprises 40% or greater (e.g., 40%, 45%, 50%, 55%, 60%, 65%, 70%, 75%, 80%, 85%, 90%, 95%, or more) sequence identity to SEQ ID NO: 791, and the one or more complementary peptides, dipeptides, tripeptides, and/or polypeptides collectively comprise 40% or greater (e.g., 40%, 45%, 50%, 55%, 60%, 65%, 70%, 75%, 80%, 85%, 90%, 95%, or more) sequence identity to SEQ ID NO: 799. In some embodiments, the polypeptide component comprises 40% or greater (e.g., 40%, 45%, 50%, 55%, 60%, 65%, 70%, 75%, 80%, 85%, 90%, 95%, or more) sequence identity to SEQ ID NO: 792, and the one or more complementary peptides, dipeptides, tripeptides, and/or polypeptides collectively comprise 40% or greater (e.g., 40%, 45%, 50%, 55%, 60%, 65%, 70%, 75%, 80%, 85%, 90%, 95%, or more) sequence identity to SEQ ID NO: 800. In some embodiments, the polypeptide component comprises 40% or greater (e.g., 40%, 45%, 50%, 55%, 60%, 65%, 70%, 75%, 80%, 85%, 90%, 95%, or more) sequence identity to SEQ ID NO: 793, and the one or more complementary peptides, dipeptides, tripeptides, and/or polypeptides collectively comprise 40% or greater (e.g., 40%, 45%, 50%, 55%, 60%, 65%, 70%, 75%, 80%, 85%, 90%, 95%, or more) sequence identity to SEQ ID 801. In some embodiments, the bioluminescent signal is substantially increased when the polypeptide component associates with the one or more complementary peptides, dipeptides, tripeptides, and/or polypeptides. In some embodiments, polypeptide component and/or one or more complementary peptides, dipeptides, tripeptides, and/or polypeptides comprise amino acid sequences that are not a naturally occurring sequences or fragments thereof. In some embodiments, polypeptide component and/or one or more complementary peptides, dipeptides, tripeptides, and/ or polypeptides comprise a non-natural amino acid, an amino acid analog, and/or peptoid amino acids. In some embodiments, the polypeptide component and/or one or more complementary peptides, dipeptides, tripeptides, and/ or polypeptides are present as fusions with one or more additional amino acid sequences. In some embodiments, the additional amino acid sequence is selected from the group consisting of a protein of interest, an interaction element, a co-localization element, and a binding moiety. In some embodiments, the additional amino acid sequence is a binding moiety selected from the group consisting of antibody (polyclonal, monoclonal, and/or recombinant), antibody fragment, protein A, an Ig binding domain of protein A, protein G, an Ig binding domain of protein G, protein A/G, an Ig binding domain of protein A/G, protein L, an Ig binding domain of protein L, protein M, an Ig binding domain of protein M, oligonucleotide probe, peptide nucleic acid, DARPin, aptamer, affimer, a purified protein (either the analyte itself or a protein that binds to the analyte), and analyte binding domain(s) of proteins. In some embodiments, the additional amino acid sequence is a first interaction polypeptide that is configured to form a complex with a second interaction polypeptide upon contact of the first interaction polypeptide and the second interaction polypeptide. In some embodiments, the additional amino acid sequence is a first co-localization polypeptide that is configured to co-localize within a cellular compartment, a cell, a tissue, or an organism within a with a second co-localization polypeptide. In some embodiments, the additional amino acid sequence is a protein of interest and is a candidate drug target. In some embodiments, provided herein are bioluminescent complexes comprising the polypeptide component and one or more complementary peptides, dipeptides, tripeptide, and/or polypeptides of the systems or kits described herein.

In some embodiments, provided herein are systems or kits comprising two or more peptide, dipeptide, tripeptide and/or polypeptide components collectively comprising 40% or greater (e.g., 40%, 45%, 50%, 55%, 60%, 65%, 70%, 75%, 80%, 85%, 90%, 95%, or more) sequence identity to SEQ ID NO: 788 or SEQ ID NO: 789; wherein a bioluminescent signal produced by the bioluminescent complex in the presence of a coelenterazine or a coelenterazine analog substrate is substantially increased when compared to a bioluminescent signal produced by the polypeptide or one or more complementary peptides and the coelenterazine substrate alone. In some embodiments, a system of kit comprises a polypeptide component having 40% or greater (e.g., 40%, 45%, 50%, 55%, 60%, 65%, 70%, 75%, 80%, 85%, 90%, 95%, or more) sequence identity to SEQ ID NO: 790, and the one or more complementary peptides, dipeptides, and or tripeptides collectively having 40% or greater (e.g., 40%, 45%, 50%, 55%, 60%, 65%, 70%, 75%, 80%, 85%, 90%, 95%, or more) sequence identity to SEQ ID NO: 794. In some embodiments, the polypeptide comprises 40% or greater (e.g., 40%, 45%, 50%, 55%, 60%, 65%, 70%, 75%, 80%, 85%, 90%, 95%, or more) sequence identity to SEQ ID NO: 791, and the one or more complementary peptides collectively comprise 40% or greater (e.g., 40%, 45%, 50%, 55%, 60%, 65%, 70%, 75%, 80%, 85%, 90%, 95%, or more) sequence identity to SEQ ID NO: 795. In some embodiments, the polypeptide comprises 40% or greater (e.g., 40%, 45%, 50%, 55%, 60%, 65%, 70%, 75%, 80%, 85%, 90%, 95%, or more) sequence identity to SEQ ID NO: 792, and the one or more complementary peptides collectively comprise 40% or greater (e.g., 40%, 45%, 50%, 55%, 60%, 65%, 70%, 75%, 80%, 85%, 90%, 95%, or more) sequence identity to SEQ ID NO: 796. In some embodiments, the polypeptide comprises 40% or greater (e.g., 40%, 45%, 50%, 55%, 60%, 65%, 70%, 75%, 80%, 85%, 90%, 95%, or more) sequence identity to SEQ ID NO: 793, and the one or more complementary peptides collectively comprise 40% or greater (e.g., 40%, 45%, 50%, 55%, 60%, 65%, 70%, 75%, 80%, 85%, 90%, 95%, or more) sequence identity to SEQ ID NO: 797. In some embodiments, the polypeptide comprises 40% or greater (e.g., 40%, 45%, 50%, 55%, 60%, 65%, 70%, 75%, 80%, 85%, 90%, 95%, or more) sequence identity to SEQ ID NO: 790, and the one or more complementary peptides collectively comprise 40% or greater (e.g., 40%, 45%, 50%, 55%, 60%, 65%, 70%, 75%, 80%, 85%, 90%, 95%, or more) sequence identity to SEQ ID NO: 798. In some embodiments, the polypeptide comprises 40% or greater (e.g., 40%, 45%, 50%, 55%, 60%, 65%, 70%, 75%, 80%, 85%, 90%, 95%, or more) sequence identity to SEQ ID NO: 791, and the one or more complementary peptides collectively comprise 40% or greater (e.g., 40%, 45%, 50%, 55%, 60%, 65%, 70%, 75%, 80%, 85%, 90%, 95%, or more) sequence identity to SEQ ID NO: 799. In some embodiments, the polypeptide comprises 40% or greater (e.g., 40%, 45%, 50%, 55%, 60%, 65%, 70%, 75%, 80%, 85%, 90%, 95%, or more) sequence identity to SEQ ID NO: 792, and the one or more complementary peptides collectively comprise 40% or greater (e.g., 40%, 45%, 50%, 55%, 60%, 65%, 70%, 75%, 80%, 85%, 90%, 95%, or more) sequence identity to SEQ ID NO: 800. In some embodiments, the polypeptide comprises 40% or greater (e.g., 40%, 45%, 50%, 55%, 60%, 65%, 70%, 75%, 80%, 85%, 90%, 95%, or more) sequence identity to SEQ ID NO: 793, and the one or more complementary peptides collectively comprise 40% or greater (e.g., 40%, 45%, 50%, 55%, 60%, 65%, 70%, 75%, 80%, 85%, 90%, 95%, or more) sequence identity to SEQ ID NO: 801. In some embodiments, the bioluminescent signal is substantially increased when the polypeptide associates with the one or more complementary peptides. In some embodiments, the polypeptide and/or one or more complementary peptides comprise amino acid sequences that are not a naturally occurring sequences or fragments thereof. In some embodiments, polypeptide and/or one or more complementary peptides comprise a non-natural amino acid, an amino acid analog, and/or peptoid amino acids. In some embodiments, the polypeptide and/or one or more complementary peptides are present as fusions with one or more additional amino acid sequences. In some embodiments, the additional amino acid sequence is selected from the group consisting of a protein of interest, an interaction element, a co-localization element, and a binding moiety. In some embodiments, the additional amino acid sequence is a binding moiety selected from the group consisting of antibody (polyclonal, monoclonal, and/or recombinant), antibody fragment, protein A, an Ig binding domain of protein A, protein G, an Ig binding domain of protein G, protein A/G, an Ig binding domain of protein A/G, protein L, an Ig binding domain of protein L, protein M, an Ig binding domain of protein M, oligonucleotide probe, peptide nucleic acid, DARPin, aptamer, affimer, a purified protein (either the analyte itself or a protein that binds to the analyte), and analyte binding domain(s) of proteins. In some embodiments, the additional amino acid sequence is a first interaction polypeptide that is configured to form a complex with a second interaction polypeptide upon contact of the first interaction polypeptide and the second interaction polypeptide. In some embodiments, the additional amino acid sequence is a first co-localization polypeptide that is configured to co-localize within a cellular compartment, a cell, a tissue, or an organism with a second co-localization polypeptide. In some embodiments, the additional amino acid sequence is a protein of interest and is a candidate drug target. In some embodiments, provided herein are bioluminescent complexes comprising the two or more peptide, dipeptide, tripeptide, and/or polypeptide components of the systems or kits described herein.

In some embodiments, provided herein are methods comprising: (a) combining: (i) a polypeptide component comprising 40% or greater (e.g., 40%, 45%, 50%, 55%, 60%, 65%, 70%, 75%, 80%, 85%, 90%, 95%, or more) sequence identity to a polypeptide fragment of SEQ ID NO: 788 or SEQ ID NO: 789; (ii) one or more complementary peptides, dipeptides, tripeptides, and/or polypeptides collectively comprising 40% or greater (e.g., 40%, 45%, 50%, 55%, 60%, 65%, 70%, 75%, 80%, 85%, 90%, 95%, or more) sequence identity to the complementary portion of SEQ ID NO: 788 or SEQ ID NO: 789; and (iii) a coelenterazine or a coelenterazine analog substrate; and (b) detecting luminescence, wherein a greater level of luminescence compared to a level of luminescence produced by the polypeptide component and a coelenterazine or a coelenterazine analog alone indicates formation of a bioluminescent complex of the polypeptide component and the one or more complementary peptides. In some embodiments, one or more of the polypeptide component and the first and second peptides are expressed in a cell, added to a cell exogenously, and/or added to a sample. In some embodiments, (i) the polypeptide component comprises 40% or greater (e.g., 40%, 45%, 50%, 55%, 60%, 65%, 70%, 75%, 80%, 85%, 90%, 95%, or more) sequence identity to SEQ ID NO: 790 and the one or more complementary peptides, dipeptides, tripeptides, and/or polypeptides collectively comprise 40% or greater (e.g., 40%, 45%, 50%, 55%, 60%, 65%, 70%, 75%, 80%, 85%, 90%, 95%, or more) sequence identity to SEQ ID NO: 794; (ii) the polypeptide component comprises 40% or greater (e.g., 40%, 45%, 50%, 55%, 60%, 65%, 70%, 75%, 80%, 85%, 90%, 95%, or more) sequence identity to SEQ ID NO: 791, and the one or more complementary peptides, dipeptides, tripeptides, and/or polypeptides collectively comprise 40% or greater (e.g., 40%, 45%, 50%, 55%, 60%, 65%, 70%, 75%, 80%, 85%, 90%, 95%, or more) sequence identity to SEQ ID NO: 795; (iii) the polypeptide component comprises 40% or greater (e.g., 40%, 45%, 50%, 55%, 60%, 65%, 70%, 75%, 80%, 85%, 90%, 95%, or more) sequence identity to SEQ ID NO: 792, and the one or more complementary peptides, dipeptides, tripeptides, and/or polypeptides collectively comprise 40% or greater (e.g., 40%, 45%, 50%, 55%, 60%, 65%, 70%, 75%, 80%, 85%, 90%, 95%, or more) sequence identity to SEQ ID NO: 796; (iv) the polypeptide component comprises 40% or greater (e.g., 40%, 45%, 50%, 55%, 60%, 65%, 70%, 75%, 80%, 85%, 90%, 95%, or more) sequence identity to SEQ ID NO: 793, and the one or more complementary peptides, dipeptides, tripeptides, and/or polypeptides collectively comprise 40% or greater (e.g., 40%, 45%, 50%, 55%, 60%, 65%, 70%, 75%, 80%, 85%, 90%, 95%, or more) sequence identity to SEQ ID NO: 797; (v) the polypeptide component comprises 40% or greater (e.g., 40%, 45%, 50%, 55%, 60%, 65%, 70%, 75%, 80%, 85%, 90%, 95%, or more) sequence identity to SEQ ID NO: 790, and the one or more complementary peptides, dipeptides, tripeptides, and/or polypeptides collectively comprise 40% or greater (e.g., 40%, 45%, 50%, 55%, 60%, 65%, 70%, 75%, 80%, 85%, 90%, 95%, or more) sequence identity to SEQ ID NO: 798; (vi) the polypeptide component comprises 40% or greater (e.g., 40%, 45%, 50%, 55%, 60%, 65%, 70%, 75%, 80%, 85%, 90%, 95%, or more) sequence identity to SEQ ID NO: 791, and the one or more complementary peptides, dipeptides, tripeptides, and/or polypeptides collectively comprise 40% or greater (e.g., 40%, 45%, 50%, 55%, 60%, 65%, 70%, 75%, 80%, 85%, 90%, 95%, or more) sequence identity to SEQ ID NO: 799; (vii) the polypeptide component comprises 40% or greater (e.g., 40%, 45%, 50%, 55%, 60%, 65%, 70%, 75%, 80%, 85%, 90%, 95%, or more) sequence identity to SEQ ID NO: 792, and the one or more complementary peptides, dipeptides, tripeptides, and/or polypeptides collectively comprise 40% or greater (e.g., 40%, 45%, 50%, 55%, 60%, 65%, 70%, 75%, 80%, 85%, 90%, 95%, or more) sequence identity to SEQ ID NO: 800; or (viii) the polypeptide component comprises 40% or greater (e.g., 40%, 45%, 50%, 55%, 60%, 65%, 70%, 75%, 80%, 85%, 90%, 95%, or more) sequence identity to SEQ ID NO: 793, and the one or more complementary peptides, dipeptides, tripeptides, and/or polypeptides collectively comprise 40% or greater (e.g., 40%, 45%, 50%, 55%, 60%, 65%, 70%, 75%, 80%, 85%, 90%, 95%, or more) sequence identity to SEQ ID 801.

In some embodiments, provided herein are methods comprising: (a) combining: (i) two or more peptide, dipeptide, tripeptide, and/or polypeptide components collectively comprising 40% or greater (e.g., 40%, 45%, 50%, 55%, 60%, 65%, 70%, 75%, 80%, 85%, 90%, 95%, or more) sequence identity to the full length of SEQ ID NO: 788 or SEQ ID NO: 789; and (ii) a coelenterazine or a coelenterazine analog substrate; and (b) detecting luminescence, wherein a greater level of luminescence compared to a level of luminescence produced by the peptide, dipeptide, tripeptide, and/or polypeptide components and the coelenterazine or coelenterazine analog indicates formation of a bioluminescent complex of the peptide and polypeptide components. In some embodiments, one or more of the polypeptide components and the first and second peptides may be expressed in a cell, added to a cell exogenously, and/or added to a sample. In some embodiments, (i) the polypeptide component comprises 40% or greater (e.g., 40%, 45%, 50%, 55%, 60%, 65%, 70%, 75%, 80%, 85%, 90%, 95%, or more) sequence identity to SEQ ID NO: 790, and the one or more complementary peptides, dipeptides, tripeptides, and/or polypeptides collectively comprise 40% or greater (e.g., 40%, 45%, 50%, 55%, 60%, 65%, 70%, 75%, 80%, 85%, 90%, 95%, or more) sequence identity to SEQ ID NO: 794; (ii) the polypeptide component comprises 40% or greater (e.g., 40%, 45%, 50%, 55%, 60%, 65%, 70%, 75%, 80%, 85%, 90%, 95%, or more) sequence identity to SEQ ID NO: 791, and the one or more complementary peptides, dipeptides, tripeptides, and/or polypeptides collectively comprise 40% or greater (e.g., 40%, 45%, 50%, 55%, 60%, 65%, 70%, 75%, 80%, 85%, 90%, 95%, or more) sequence identity to SEQ ID NO: 795; (iii) the polypeptide component comprises 40% or greater (e.g., 40%, 45%, 50%, 55%, 60%, 65%, 70%, 75%, 80%, 85%, 90%, 95%, or more) sequence identity to SEQ ID NO: 792, and the one or more complementary peptides, dipeptides, tripeptides, and/or polypeptides collectively comprise 40% or greater (e.g., 40%, 45%, 50%, 55%, 60%, 65%, 70%, 75%, 80%, 85%, 90%, 95%, or more) sequence identity to SEQ ID NO: 796; (iv) the polypeptide component comprises 40% or greater (e.g., 40%, 45%, 50%, 55%, 60%, 65%, 70%, 75%, 80%, 85%, 90%, 95%, or more) sequence identity to SEQ ID NO: 793, and the one or more complementary peptides, dipeptides, tripeptides, and/or polypeptides collectively comprise 40% or greater (e.g., 40%, 45%, 50%, 55%, 60%, 65%, 70%, 75%, 80%, 85%, 90%, 95%, or more) sequence identity to SEQ ID NO: 797; (v) the polypeptide component comprises 40% or greater (e.g., 40%, 45%, 50%, 55%, 60%, 65%, 70%, 75%, 80%, 85%, 90%, 95%, or more) sequence identity to SEQ ID NO: 790, and the one or more complementary peptides, dipeptides, tripeptides, and/or polypeptides collectively comprise 40% or greater (e.g., 40%, 45%, 50%, 55%, 60%, 65%, 70%, 75%, 80%, 85%, 90%, 95%, or more) sequence identity to SEQ ID NO: 798; (vi) the polypeptide component comprises 40% or greater (e.g., 40%, 45%, 50%, 55%, 60%, 65%, 70%, 75%, 80%, 85%, 90%, 95%, or more) sequence identity to SEQ ID NO: 791, and the one or more complementary peptides, dipeptides, tripeptides, and/or polypeptides collectively comprise 40% or greater (e.g., 40%, 45%, 50%, 55%, 60%, 65%, 70%, 75%, 80%, 85%, 90%, 95%, or more) sequence identity to SEQ ID NO: 799; (vii) the polypeptide component comprises 40% or greater (e.g., 40%, 45%, 50%, 55%, 60%, 65%, 70%, 75%, 80%, 85%, 90%, 95%, or more) sequence identity to SEQ ID NO: 792, and the one or more complementary peptides, dipeptides, tripeptides, and/or polypeptides collectively comprise 40% or greater (e.g., 40%, 45%, 50%, 55%, 60%, 65%, 70%, 75%, 80%, 85%, 90%, 95%, or more) sequence identity to SEQ ID NO: 800; or (viii) the polypeptide component comprises 40% or greater (e.g., 40%, 45%, 50%, 55%, 60%, 65%, 70%, 75%, 80%, 85%, 90%, 95%, or more) sequence identity to SEQ ID NO: 793, and the one or more complementary peptides, dipeptides, tripeptides, and/or polypeptides collectively comprise 40% or greater (e.g., 40%, 45%, 50%, 55%, 60%, 65%, 70%, 75%, 80%, 85%, 90%, 95%, or more) sequence identity to SEQ ID 801.

In some embodiments, provided herein are methods of detecting an interaction between a first molecular entity and a second molecular entity, the method comprising: (a) tagging the first molecular entity with a first peptide, dipeptide, or tripeptide tag; (b) tagging the second molecular entity with a second peptide, dipeptide, or tripeptide tag; (c) combining the tagged first molecular entity and the tagged second molecular entity and/or allowing the tagged first molecular entity and the tagged second molecular entity to come into contact with one another; (d) adding one or more peptide, dipeptide, tripeptide, and/or polypeptide components, wherein the first peptide, dipeptide, or tripeptide tag, the second peptide, dipeptide, or tripeptide tag, and the peptide, dipeptide, tripeptide, and/or polypeptide components collectively comprise an amino acid sequence having 40% or greater (e.g., 40%, 45%, 50%, 55%, 60%, 65%, 70%, 75%, 80%, 85%, 90%, 95%, or more) sequence identity with the entirety of SEQ ID NO: 788 or 789, and capable of assembling to form a bioluminescent complex; (e) adding a coelenterazine or a coelenterazine analog substrate; and (f) detecting a luminescent signal produced by the bioluminescent complex, wherein the magnitude of the luminescent signal correlates to the strength of the interaction between the first molecular entity and the second molecular entity. In some embodiments, the first molecular entity and/or the second molecular entity is a protein of interest or a peptide of interest and tagging comprises generating a fusion of the first molecular entity and/or the second molecular entity with the first tag and/or second tag. In some embodiments, the first molecular entity and/or the second molecular entity is a small molecule and tagging comprises directly or indirectly linking the first molecular entity and/or the second molecular entity with the first tag and/or second tag. In some embodiments, one of the first molecular entity and the second molecular entity is a drug or drug candidate and the other is a drug target or candidate drug target, and the bioluminescent signal indicates binding of the drug or drug candidate to the other is a drug target or candidate drug target. In some embodiments, combining the tagged first molecular entity and the tagged second molecular entity comprises expressing one or both within a cell and/or adding one or both to a cell.

In some embodiments, provided herein are methods of detecting an interaction between a first protein or peptide entity and a second protein or peptide entity with a cell comprising, the method comprising: (a) expressing within the cell a fusion comprising the first protein or peptide entity and a first peptide, dipeptide, or tripeptide tag comprising an amino acid sequence having 40% or greater (e.g., 40%, 45%, 50%, 55%, 60%, 65%, 70%, 75%, 80%, 85%, 90%, 95%, or more) sequence identity with a first portion of SEQ ID NO: 788 or 789; (b) expressing within the cell a fusion comprising the second protein or peptide entity and a second peptide, dipeptide, or tripeptide tag comprising an amino acid sequence having 40% or greater (e.g., 40%, 45%, 50%, 55%, 60%, 65%, 70%, 75%, 80%, 85%, 90%, 95%, or more) sequence identity with a second portion of SEQ ID NO: 788 or 789; (c) expressing within the cell one or more peptide, dipeptide, tripeptide, and/or polypeptide components comprising an amino acid sequence having 40% or greater (e.g., 40%, 45%, 50%, 55%, 60%, 65%, 70%, 75%, 80%, 85%, 90%, 95%, or more) sequence identity with a third portion of SEQ ID NO: 788 or 789, wherein the first tag, the second tag, and the components collectively comprise 40% or greater (e.g., 40%, 45%, 50%, 55%, 60%, 65%, 70%, 75%, 80%, 85%, 90%, 95%, or more) sequence identity with the entirety of SEQ ID NO: 788 or 789 and are configured to produce a bioluminescent complex upon interaction of the first protein or peptide entity and the second protein or peptide entity; (d) adding a coelenterazine or a coelenterazine analog substrate to the cell; and (e) detecting a luminescent signal produced by the bioluminescent complex, wherein the magnitude of the luminescent signal correlates to the strength of the interaction between the first protein or peptide entity and the second protein or peptide entity.

In some embodiments, provided herein are methods of detecting co-localization of a first molecular entity and a second molecular entity, the method comprising: (a) tagging the first molecular entity with a first peptide, dipeptide, or tripeptide tag comprising an amino acid sequence having 40% or greater (e.g., 40%, 45%, 50%, 55%, 60%, 65%, 70%, 75%, 80%, 85%, 90%, 95%, or more) sequence identity with a first portion of SEQ ID NO: 788 or 789; (b) tagging the second molecular entity with a second peptide, dipeptide, or tripeptide tag comprising an amino acid sequence having 40% or greater (e.g., 40%, 45%, 50%, 55%, 60%, 65%, 70%, 75%, 80%, 85%, 90%, 95%, or more) sequence identity with a second portion of SEQ ID NO: 788 or 789; (c) combining the tagged first molecular entity and the tagged second molecular entity in the same system; (d) adding one or more peptide, dipeptide, tripeptide, and/or polypeptide components to the system, the components having 40% or greater (e.g., 40%, 45%, 50%, 55%, 60%, 65%, 70%, 75%, 80%, 85%, 90%, 95%, or more) sequence identity with a third portion of SEQ ID NO: 788 or 789, wherein the first tag, the second tag, and the components collectively comprise 40% or greater (e.g., 40%, 45%, 50%, 55%, 60%, 65%, 70%, 75%, 80%, 85%, 90%, 95%, or more) sequence identity with the entirety of SEQ ID NO: 788 or 789, wherein the first peptide tag, the second peptide tag, and components are configured to produce a bioluminescent complex upon co-localization of the first molecular entity and the second molecular entity; (e) adding a coelenterazine or a coelenterazine analog substrate to the system; and (f) detecting a luminescent signal produced by the bioluminescent complex, wherein the presence of luminescent signal above background indicates co-localization of the first molecular entity and the second molecular entity within the system, and/or wherein the magnitude of the luminescent signal correlates to the amount of co-localization within the system of the first molecular entity and the second molecular entity. In some embodiments, the system comprises a cell, tissue, organ, whole organism, and/or a biochemical, non-cellular sample. In some embodiments, the first molecular entity and/or the second molecular entity is a protein of interest or a peptide of interest, and tagging comprises generating a fusion of the first molecular entity and/or the second molecular entity with the first tag and/or peptide tag. In some embodiments, the first molecular entity and/or the second molecular entity is a small molecule and tagging comprises directly or indirectly linking the first molecular entity and/or the second molecular entity with the first tag and/or second tag. In some embodiments, combining the tagged first molecular entity and the tagged second molecular entity comprises expressing one or both within the system and/or adding one or both to the system.

In some embodiments, provided herein are methods of detecting co-localization of a first protein or peptide entity and a second protein or peptide entity with a cell comprising, the method comprising: (a) expressing within the cell a fusion comprising the first protein or peptide entity and a first peptide, dipeptide, or tripeptide tag comprising an amino acid sequence having 40% or greater (e.g., 40%, 45%, 50%, 55%, 60%, 65%, 70%, 75%, 80%, 85%, 90%, 95%, or more) sequence identity with a first portion of SEQ ID NO: 788 or 789; (b) expressing within the cell a fusion comprising the second protein or peptide entity and a second peptide, dipeptide, or tripeptide tag comprising an amino acid sequence having 40% or greater (e.g., 40%, 45%, 50%, 55%, 60%, 65%, 70%, 75%, 80%, 85%, 90%, 95%, or more) sequence identity with a second portion of SEQ ID NO: 788 or 789; (c) expressing with the cell one or more peptide, dipeptide, tripeptide, or polypeptide components having 40% or greater (e.g., 40%, 45%, 50%, 55%, 60%, 65%, 70%, 75%, 80%, 85%, 90%, 95%, or more) sequence identity with a third portion of SEQ ID NO: 788 or 789, wherein the first tag, the second tag, and the components collectively comprise 40% or greater (e.g., 40%, 45%, 50%, 55%, 60%, 65%, 70%, 75%, 80%, 85%, 90%, 95%, or more) sequence identity with the entirety of SEQ ID NO: 788 or 789, wherein the first tag, the second tag, and the components are configured to produce a bioluminescent complex upon co-localization of the first protein or peptide entity and the second protein or peptide entity; (d) adding a coelenterazine or a coelenterazine analog substrate to the cell; and (e) detecting a luminescent signal produced by the bioluminescent complex, wherein the presence of luminescent signal above background indicates co-localization of the first protein or peptide entity and the second protein or peptide entity within the cell, and/or wherein the magnitude of the luminescent signal correlates to the amount of co-localization within the system of the first protein or peptide entity and the second protein or peptide entity.

In some embodiments, provided herein are methods of detecting a target molecule, wherein the target molecule displays a first antigen, epitope, or sequence and a distinct second antigen, epitope, or sequence, the method comprising: (a) contacting a sample containing the target molecule with (i) a first primary binding moiety that recognizes the first antigen, epitope, or sequence and (ii) a second primary binding moiety that recognizes the second antigen, epitope, or sequence and allowing the first and second primary binding moieties to bind to the first and second antigens, epitopes, or sequences; (b) contacting the sample with (i) a first secondary binding moiety conjugated to a first tag and (ii) a second secondary binding moiety conjugated to second tag, wherein the first secondary binding moiety recognizes the first primary binding moiety and the second secondary binding moiety recognizes the second primary binding moiety, wherein the first or second tags comprises amino acid sequences having 40% or greater (e.g., 40%, 45%, 50%, 55%, 60%, 65%, 70%, 75%, 80%, 85%, 90%, 95%, or more) sequence identity with first and second portions of SEQ ID NO: 788 or 789; (c) allowing the first and second secondary binding moieties to bind to the first and second primary binding moieties; (d) contacting the sample with comprising one or more peptide, dipeptide, tripeptide, and/or polypeptide components having 40% or greater (e.g., 40%, 45%, 50%, 55%, 60%, 65%, 70%, 75%, 80%, 85%, 90%, 95%, or more) sequence identity with a third portion of SEQ ID NO: 788 or 789; wherein the first tag, the second tag, and the components collectively comprise 40% or greater (e.g., 40%, 45%, 50%, 55%, 60%, 65%, 70%, 75%, 80%, 85%, 90%, 95%, or more) sequence identity with the entirety of SEQ ID NO: 788 or 789, wherein the first tag, the second tag, and the components are configured to produce a bioluminescent complex upon interaction; (d) contacting the sample with a coelenterazine or a coelenterazine analog substrate; and (e) detecting a luminescent signal produced by the bioluminescent complex, wherein the presence of luminescent signal above background indicates the presence of the target molecule, and/or wherein the magnitude of the luminescent signal correlates to the amount of target molecule within the sample. In some embodiments, the binding moieties are independently selected from the group consisting of an antibody (polyclonal, monoclonal, and/or recombinant), antibody fragment, protein A, an Ig binding domain of protein A, protein G, an Ig binding domain of protein G, protein A/G, an Ig binding domain of protein A/G, protein L, an Ig binding domain of protein L, protein M, an Ig binding domain of protein M, oligonucleotide probe, peptide nucleic acid, DARPin, aptamer, affimer, a purified protein (either the analyte itself or a protein that binds to the analyte), and analyte binding domain(s) of proteins. In some embodiments, the target molecule is a protein, nucleic acid, or small molecule. In some embodiments, the sample is in vitro or in vivo.

In some embodiments, provided herein are methods of detecting a target molecule, wherein the target molecule displays a first antigen, epitope, or sequence and a distinct second antigen, epitope, or sequence, the method comprising: (a) contacting the sample with (i) a first binding moiety conjugated to a first tag and (ii) a second binding moiety conjugated to second tag, wherein the first secondary binding moiety recognizes the first antigen, epitope, or sequence, and the second binding moiety recognizes the second antigen, epitope, or sequence, wherein the first tag comprises an amino acid sequence having 40% or greater (e.g., 40%, 45%, 50%, 55%, 60%, 65%, 70%, 75%, 80%, 85%, 90%, 95%, or more) sequence identity with a first portion of SEQ ID NO: 788 or 789, and wherein the second tag comprises an amino acid sequence with a first portion of SEQ ID NO: 788 or 789; (b) allowing the first and second binding moieties to bind to the first and second antigens, epitope, or sequences; (c) contacting the sample with a peptide, dipeptide, tripeptide, or polypeptide component having 40% or greater (e.g., 40%, 45%, 50%, 55%, 60%, 65%, 70%, 75%, 80%, 85%, 90%, 95%, or more) sequence identity with a third portion of SEQ ID NO: 788 or 789, wherein the first tag, the second tag, and the components collectively comprise 40% or greater (e.g., 40%, 45%, 50%, 55%, 60%, 65%, 70%, 75%, 80%, 85%, 90%, 95%, or more) sequence identity with the entirety of SEQ ID NO: 788 or 789, wherein the first tag, the second tag, and the components are configured to produce a bioluminescent complex upon interaction; (d) contacting the sample with a coelenterazine or a coelenterazine analog substrate; and (e) detecting a luminescent signal produced by the bioluminescent complex, wherein the presence of luminescent signal above background indicates the presence of the target molecule, and/or wherein the magnitude of the luminescent signal correlates to the amount of target molecule within the sample. In some embodiments, the binding moieties are independently selected from the group consisting of an antibody (polyclonal, monoclonal, and/or recombinant), antibody fragment, protein A, an Ig binding domain of protein A, protein G, an Ig binding domain of protein G, protein A/G, an Ig binding domain of protein A/G, protein L, an Ig binding domain of protein L, protein M, an Ig binding domain of protein M, oligonucleotide probe, peptide nucleic acid, DARPin, aptamer, affimer, a purified protein (either the analyte itself or a protein that binds to the analyte), and analyte binding domain(s) of proteins. In some embodiments, the target molecule is a protein, nucleic acid, or small molecule. In some embodiments, the sample is in vitro, in vivo, or a biochemical sample.

In some embodiments, provided herein are peptides, dipeptides, tripeptides, and/or polypeptides listed in Table 1, Table 9, or Table 10. In some embodiments, a single peptide, dipeptide, tripeptide, or polypeptide listed in Table 1, Table 9, or Table 10 is provided (e.g., as a reagent, as a tag, etc.). In some embodiments, a pair (2) or set (e.g., 2, 3, 4, 5, or more) of peptides, dipeptides, tripeptides, and/or polypeptides listed in Table 1, Table 9, or Table 10 are provided. In particular, pairs or sets of the peptides, dipeptides, tripeptides, and/or polypeptides are provided that are complementary and are capable of forming a bioluminescent complex upon interaction (e.g., facilitated, unfacilitated) with one another.

In some embodiments, the polypeptide component comprises 40% or greater (e.g., 40%, 45%, 50%, 55%, 60%, 65%, 70%, 75%, 80%, 85%, 90%, 95%, or more) sequence identity to one of SEQ ID NOS: 909, 911, 913, 915, 917, 919, 921, 923, 925, 927, 929, 931, 933, 935, 937, 939, 941, 943, 945, 947, 949, 951, 953, 955, 957, 959, 961, 963, 965, 967, 969, 117, 119, 121, 123, 125, 127, 129, 131, 596, 598, 600, 602, 604, 606, 608, 610, 612, 614, 616, 618, 620, 622, 624, 626, 628, 630, 632, 634, 636, 638, 640, 642, 644, 646, 648, 650, 652, 654, 656, 658, 660, 662, 664, 666, 668, 670, 672, 674, 676, 678, 680, 682, 684, 686, 688, 690, 692, 694, 696, 698, 700, 702, 704, 706, 708, 710, 712, 714, 716, 718, 720, 722, 724, 726, 728, 730, 732, 734, 736, 738, 740, 742, 744, 746, 748, 750, 752, 754, 756, 758, 760, 762, 764, 766, 768, 770, 772, 774, 776, 778, 780, 782, 784, 786, 802, 804, 806, 808, 813, 815, or 829. In some embodiments, a polypeptide comprising 40% or greater (e.g., 40%, 45%, 50%, 55%, 60%, 65%, 70%, 75%, 80%, 85%, 90%, 95%, or more) sequence identity to one of SEQ ID NOS: 909, 911, 913, 915, 917, 919, 921, 923, 925, 927, 929, 931, 933, 935, 937, 939, 941, 943, 945, 947, 949, 951, 953, 955, 957, 959, 961, 963, 965, 967, 969, 117, 119, 121, 123, 125, 127, 129, 131, 596, 598, 600, 602, 604, 606, 608, 610, 612, 614, 616, 618, 620, 622, 624, 626, 628, 630, 632, 634, 636, 638, 640, 642, 644, 646, 648, 650, 652, 654, 656, 658, 660, 662, 664, 666, 668, 670, 672, 674, 676, 678, 680, 682, 684, 686, 688, 690, 692, 694, 696, 698, 700, 702, 704, 706, 708, 710, 712, 714, 716, 718, 720, 722, 724, 726, 728, 730, 732, 734, 736, 738, 740, 742, 744, 746, 748, 750, 752, 754, 756, 758, 760, 762, 764, 766, 768, 770, 772, 774, 776, 778, 780, 782, 784, 786, 802, 804, 806, 808, 813, 815, or 829 is provided with one or more peptides or dipeptides capable of forming a bioluminescent complex. In some embodiments, suitable fragments of SEQ ID NOS: 909, 911, 913, 915, 917, 919, 921, 923, 925, 927, 929, 931, 933, 935, 937, 939, 941, 943, 945, 947, 949, 951, 953, 955, 957, 959, 961, 963, 965, 967, 969, 117, 119, 121, 123, 125, 127, 129, 131, 596, 598, 600, 602, 604, 606, 608, 610, 612, 614, 616, 618, 620, 622, 624, 626, 628, 630, 632, 634, 636, 638, 640, 642, 644, 646, 648, 650, 652, 654, 656, 658, 660, 662, 664, 666, 668, 670, 672, 674, 676, 678, 680, 682, 684, 686, 688, 690, 692, 694, 696, 698, 700, 702, 704, 706, 708, 710, 712, 714, 716, 718, 720, 722, 724, 726, 728, 730, 732, 734, 736, 738, 740, 742, 744, 746, 748, 750, 752, 754, 756, 758, 760, 762, 764, 766, 768, 770, 772, 774, 776, 778, 780, 782, 784, 786, 802, 804, 806, 808, 813, 815, or 829 ofpolypeptides having % or greater (e.g., 40%,45%, 50%, 55%, 60%, 65%, 70%, 75%, 80%, 85%, 90%, 95%, or more) sequence identity to one of SEQ ID NOS: 909, 911, 913, 915, 917, 919, 921, 923, 925, 927, 929, 931, 933, 935, 937, 939, 941, 943, 945, 947, 949, 951, 953, 955, 957, 959, 961, 963, 965, 967, 969, 117, 119, 121, 123, 125, 127, 129, 131, 596, 598, 600, 602, 604, 606, 608, 610, 612, 614, 616, 618, 620, 622, 624, 626, 628, 630, 632, 634, 636, 638, 640, 642, 644, 646, 648, 650, 652, 654, 656, 658, 660, 662, 664, 666, 668, 670, 672, 674, 676, 678, 680, 682, 684, 686, 688, 690, 692, 694, 696, 698, 700, 702, 704, 706, 708, 710, 712, 714, 716, 718, 720, 722, 724, 726, 728, 730, 732, 734, 736, 738, 740, 742, 744, 746, 748, 750, 752, 754, 756, 758, 760, 762, 764, 766, 768, 770, 772, 774, 776, 778, 780, 782, 784, 786, 802, 804, 806, 808, 813, 815, or 829 are provided. In some embodiments, such fragments are capable of forming bioluminescent complexes with a suitable set of peptides, dipeptides, tripeptides, polypeptides, etc. provided herein.

In some embodiments, the peptide component comprises 40% or greater (e.g., 40%, 45%, 50%, 55%, 60%, 65%, 70%, 75%, 80%, 85%, 90%, 95%, or more) sequence identity to one of SEQ ID NOS: 900-907. In some embodiments, a polypeptide comprising 40% or greater (e.g., 40%, 45%, 50%, 55%, 60%, 65%, 70%, 75%, 80%, 85%, 90%, 95%, or more) sequence identity to one of SEQ ID NOS: 900-907 is provided with one or more peptides, dipeptides, tripeptides, polypeptides, etc., capable of forming a bioluminescent complex.

In some embodiments, provided herein are peptides, dipeptides, tripeptides, and/or polypeptides having at least 40% (e.g., 40%, 45%, 50%, 55%, 60%, 65%, 70%, 75%, 80%, 85%, 90%, 95%, or more) sequence identity with one or more of the peptides, dipeptides, tripeptides, and/or polypeptides listed in Table 1, Table 9, or Table 10. In some embodiments, a single peptide, dipeptide, tripeptide, or polypeptide having at least 40% (e.g., 40%,45%, 50%, 55%, 60%, 65%, 70%, 75%, 80%, 85%, 90%, 95%, or more) sequence identity with one or more of the peptides, dipeptides, tripeptides, and/or polypeptides listed in Table 1, Table 9, or Table 10 is provided (e.g., as a reagent, as a tag, etc.). In some embodiments, a pair (2) or set (e.g., 2, 3, 4, 5, or more) of peptides, dipeptides, tripeptides, and/or polypeptides having at least 40% (e.g., 40%, 45%, 50%, 55%, 60%, 65%, 70%, 75%, 80%, 85%, 90%, 95%, or more) sequence identity with one or more of the peptides, dipeptides, tripeptides, and/or polypeptides listed in Table 1, Table 9, or Table 10 is provided are provided. In particular, pairs or sets of the peptides, dipeptides, tripeptides, and/or polypeptides are provided that are complementary and are capable of forming a bioluminescent complex upon interaction (e.g., facilitated, unfacilitated) with one another.

In some embodiments, provided herein are polypeptides comprising 40% or greater (e.g., 40%, 45%, 50%, 55%, 60%, 65%, 70%, 75%, 80%, 85%, 90%, 95%, or more) sequence identity with one of SEQ ID NO: 790, 791, 792, or 793. In some embodiments, the polypeptide is provided alone or as a pair/set with complementary peptide(s), dipeptide(s), and/or tripeptide for the formation of a bioluminescent complex. In some embodiments, fusions of polypeptides herein with proteins of interest, interaction elements, colocalization elements, etc., are provided. In some embodiments, nucleic acids and vectors encoding the polypeptides and fusions thereof or provided.

In some embodiments, provided herein are peptides comprising SEQ ID NO: 817, 818, 819, 13, 15, 23, or 25. In some embodiments, provided herein are peptides comprising 40% or greater (e.g., 40%, 45%, 50%, 55%, 60%, 65%, 70%, 75%, 80%, 85%, 90%, 95%, or more) sequence identity with one of SEQ ID NO: 817, 818, 819, 13, 15, 23, or 25. In some embodiments, the peptide is provided alone or as a pair/set with complementary polypeptide and/or other peptide(s), dipeptide(s), and/or tripeptide for the formation of a bioluminescent complex. In some embodiments, fusions of peptides herein with proteins of interest, interaction elements, colocalization elements, etc., are provided. In some embodiments, nucleic acids and vectors encoding the peptides and fusions thereof or provided. In some embodiments, molecules of interest and/or proteins of interest are tagged with a peptide herein.

In some embodiments, provided herein is a $\beta_{6-7}$-like dipeptide comprising SEQ ID NOS: 817 and 818. In some embodiments, provided herein is a $\beta_{6-7}$-like dipeptide having 40% or greater (e.g., 40%, 45%, 50%, 55%, 60%, 65%, 70%, 75%, 80%, 85%, 90%, 95%, or more) sequence identity with SEQ ID NOS: 817 and 818. In some embodiments, the dipeptide is provided alone or as a pair/set with complementary polypeptide and/or other peptide(s), dipeptide(s), and/or tripeptide for the formation of a bioluminescent complex. In some embodiments, nucleic acids and vectors encoding the dipeptides and fusions thereof or provided. In some embodiments, molecules of interest and/or proteins of interest are tagged with a dipeptide herein.

In some embodiments, provided herein is a β7-8-like dipeptide comprising SEQ ID NOS: 818 and 819. In some embodiments, provided herein is a β7-8-like dipeptide having 40% or greater (e.g., 40%, 45%, 50%, 55%, 60%, 65%, 70%, 75%, 80%, 85%, 90%, 95%, or more) sequence identity with SEQ ID NOS: 818 and 819. In some embodiments, the dipeptide is provided alone or as a pair/set with complementary polypeptide and/or other peptide(s), dipeptide(s), and/or tripeptide for the formation of a bioluminescent complex. In some embodiments, the dipeptide is provided alone or as a pair/set with complementary polypeptide and/or other peptide(s), dipeptide(s), and/or tripeptide for the formation of a bioluminescent complex. In some embodiments, nucleic acids and vectors encoding the dipeptides and fusions thereof or provided. In some embodiments, molecules of interest and/or proteins of interest are tagged with a dipeptide herein.

In some embodiments, provided herein is a $\beta_{8-9}$-like dipeptide comprising SEQ ID NOS: 819/23 or 819/25. In some embodiments, provided herein is a $\beta_{8-9}$-like dipeptide having 40% or greater (e.g., 40%, 45%, 50%, 55%, 60%, 65%, 70%, 75%, 80%, 85%, 90%, 95%, or more) sequence identity with NOS: 819/23 or 819/25. In some embodiments, the dipeptide is provided alone or as a pair/set with complementary polypeptide and/or other peptide(s), dipeptide(s), and/or tripeptide for the formation of a bioluminescent complex. In some embodiments, the dipeptide is provided alone or as a pair/set with complementary polypeptide and/or other peptide(s), dipeptide(s), and/or tripeptide for the formation of a bioluminescent complex. In some embodiments, nucleic acids and vectors encoding the dipeptides and fusions thereof or provided. In some embodiments, molecules of interest and/or proteins of interest are tagged with a dipeptide herein.

In some embodiments, provided herein is a β9-10-like dipeptide comprising SEQ ID NOS: 23/13, 23/15, 25/13 or 25/15. In some embodiments, provided herein is a $β_{8-9}$-like dipeptide having 40% or greater (e.g., 40%, 45%, 50%, 55%, 60%, 65%, 70%, 75%, 80%, 85%, 90%, 95%, or more) sequence identity with NOS: SEQ ID NOS: 23/13, 23/15, 25/13 or 25/15. In some embodiments, the dipeptide is provided alone or as a pair/set with complementary polypeptide and/or other peptide(s), dipeptide(s), and/or tripeptide for the formation of a bioluminescent complex. In some embodiments, the dipeptide is provided alone or as a pair/set with complementary polypeptide and/or other peptide(s), dipeptide(s), and/or tripeptide for the formation of a bioluminescent complex. In some embodiments, nucleic acids and vectors encoding the dipeptides and fusions thereof or provided. In some embodiments, molecules of interest and/or proteins of interest are tagged with a dipeptide herein.

In some embodiments, provided herein is a β6-8-like tripeptide comprising SEQ ID NOS: 817-819. In some embodiments, provided herein is a 16-8-like tripeptide having 40% or greater (e.g., 40%, 45%, 50%, 55%, 60%, 65%, 70%, 75%, 80%, 85%, 90%, 95%, or more) sequence identity with NOS: SEQ ID NOS: 817-819. In some embodiments, the tripeptide is provided alone or as a pair/set with complementary polypeptide and/or other peptide(s), dipeptide(s), and/or tripeptide for the formation of a bioluminescent complex. In some embodiments, the tripeptide is provided alone or as a pair/set with complementary polypeptide and/or other peptide(s), dipeptide(s), and/or tripeptide for the formation of a bioluminescent complex. In some embodiments, nucleic acids and vectors encoding the tripeptides and fusions thereof or provided. In some embodiments, molecules of interest and/or proteins of interest are tagged with a tripeptide herein.

In some embodiments, provided herein is a $β_{7-9}$-like tripeptide comprising SEQ ID NOS: 818/819/23 or 818/819/25. In some embodiments, provided herein is a $β_{7-9}$-like tripeptide having 40% or greater (e.g., 40%, 45%, 50%, 55%, 60%, 65%, 70%, 75%, 80%, 85%, 90%, 95%, or more) sequence identity with NOS: SEQ ID NOS: 818/819/23 or 818/819/25. In some embodiments, the tripeptide is provided alone or as a pair/set with complementary polypeptide and/or other peptide(s), dipeptide(s), and/or tripeptide for the formation of a bioluminescent complex. In some embodiments, the tripeptide is provided alone or as a pair/set with complementary polypeptide and/or other peptide(s), dipeptide(s), and/or tripeptide for the formation of a bioluminescent complex. In some embodiments, nucleic acids and vectors encoding the tripeptides and fusions thereof or provided. In some embodiments, molecules of interest and/or proteins of interest are tagged with a tripeptide herein.

In some embodiments, provided herein is a β8-10-like tripeptide comprising SEQ ID NOS: 819/23/13, 819/23/15, 819/25/13, or 819/25/15. In some embodiments, provided herein is a $β_{7-9}$-like tripeptide having 40% or greater (e.g., 40%, 45%, 50%, 55%, 60%, 65%, 70%, 75%, 80%, 85%, 90%, 95%, or more) sequence identity with SEQ ID NOS: 819/23/13, 819/23/15, 819/25/13, or 819/25/15. In some embodiments, the tripeptide is provided alone or as a pair/set with complementary polypeptide and/or other peptide(s), dipeptide(s), and/or tripeptide for the formation of a bioluminescent complex. In some embodiments, the tripeptide is provided alone or as a pair/set with complementary polypeptide and/or other peptide(s), dipeptide(s), and/or tripeptide for the formation of a bioluminescent complex. In some embodiments, the tripeptide is provided alone or as a pair/set with complementary polypeptide and/or other peptide(s), dipeptide(s), and/or tripeptide for the formation of a bioluminescent complex. In some embodiments, nucleic acids and vectors encoding the tripeptides and fusions thereof or provided. In some embodiments, molecules of interest and/or proteins of interest are tagged with a tripeptide herein.

In some embodiments, provided herein are peptides comprising an amino acid sequence having 40% or greater (e.g., 40%, 45%, 50%, 55%, 60%, 65%, 70%, 75%, 80%, 85%, 90%, 95%, or more) sequence identity with SEQ ID NO: 23 and less than 100% sequence identity with SEQ ID NO: 6 and SEQ ID NO: 9, wherein a bioluminescent signal produced in the presence of a coelenterazine or a coelenterazine analog substrate is substantially increased when the peptide contacts a second peptide consisting of SEQ ID NO: 25 and a polypeptide complement consisting of SEQ ID NO: 17, SEQ ID NO: 21, or SEQ ID NO: 302 when compared to a bioluminescent signal produced by the peptide and the coelenterazine or coelenterazine analog substrate alone. In some embodiments, the bioluminescent signal is substantially increased when the peptide associates with the second peptide and the polypeptide complement. In some embodiments, the peptide exhibits enhancement of one or more traits compared to a peptide of SEQ ID NO: 6 and/or SEQ ID NO: 9, wherein the traits are selected from: affinity for the second peptide and the polypeptide complement or enhanced expression, solubility, stability, and/or bioluminescent activity when combined with the second peptide and the polypeptide complement. In some embodiments, the amino acid sequence is not a naturally occurring protein (e.g., not SEQ ID NO: 1), not a mutant version thereof (e.g., not SEQ ID NO: 3), not a fragment of a naturally occurring protein (e.g., not SEQ ID NOS: 5-7), and not a fragment of a mutant version thereof (e.g., not one of SEQ ID NOS: 8-10). In some embodiments, the amino acid sequence contains a non-natural amino acid, an amino acid analog, and/or peptoid amino acids. In some embodiments, a peptide is chemically conjugated to a linker, reactive moiety, detection element (e.g., fluorophore), interaction/binding element, etc.

In some embodiments, provided herein are fusion polypeptides (e.g., genetic fusions (or alternatively, chemical conjugations or synthetically produced)) comprising a peptide described in the preceding paragraph and an additional amino acid sequence or compound (e.g. small molecule drug). In some embodiments, the additional amino acid sequence is selected from the group consisting of a protein of interest, an interaction element, a co-localization element, and/or a binding moiety. In some embodiments, the additional amino acid sequence is a binding moiety selected from the group consisting of an antibody (e.g., polyclonal, monoclonal, and/or recombinant), antibody fragment, protein A, an Ig binding domain of protein A, protein G, an Ig binding domain of protein G, protein A/G, an Ig binding domain of protein A/G, protein L, a Ig binding domain of protein L, protein M, an Ig binding domain of protein M, peptide nucleic acid, DARPin, affimer, a purified protein (e.g., an analyte or a protein that binds to an analyte), and analyte binding domain(s) of proteins. In some embodiments, the additional amino acid sequence is a first interaction polypeptide that is configured to form a complex with a second interaction polypeptide upon contact of the first interaction polypeptide and the second interaction polypeptide. In some embodiments, the additional amino acid sequence is a first co-localization polypeptide that is configured to co-localize within a cellular compartment, a cell, a tissue, or an organism with a second co-localization polypeptide. In some embodiments, the additional amino acid sequence is a protein of interest and is a candidate drug target.

In some embodiments, provided herein are peptides comprising an amino acid sequence having 40% or greater (e.g., 40%, 45%, 50%, 55%, 60%, 65%, 70%, 75%, 80%, 85%, 90%, 95%, or more) sequence identity with SEQ ID NO: 25 and less than 100% sequence identity with SEQ ID NO: 7 and SEQ ID NO: 10, wherein a bioluminescent signal produced in the presence of a coelenterazine or a coelenterazine analog substrate is substantially increased when the peptide contacts a second peptide consisting of SEQ ID NO: 23 and a polypeptide complement consisting of SEQ ID NO: 17, SEQ ID NO: 21, or SEQ ID NO: 302 when compared to a bioluminescent signal produced by the peptide and the coelenterazine or coelenterazine analog substrate alone. In some embodiments, the bioluminescent signal is substantially increased when the peptide associates with the second peptide and the polypeptide complement. In some embodiments, the peptide exhibits enhancement of one or more traits compared to a peptide of SEQ ID NO: 7 and/or SEQ ID NO: 10, wherein the traits are selected from: affinity for the second peptide and the polypeptide complement or enhanced expression, solubility, stability, and/or bioluminescent activity when combined with the second peptide and the polypeptide complement. In some embodiments, the amino acid sequence is not a naturally occurring protein (e.g., not SEQ ID NO: 1), not a mutant version thereof (e.g., not SEQ ID NO: 3), not a fragment of a naturally occurring protein (e.g., not SEQ ID NOS: 5-7), and not a fragment of a mutant version thereof (e.g., not one of SEQ ID NOS: 8-10). In some embodiments, the amino acid sequence contains a non-natural amino acid, an amino acid analog, and/or peptoid amino acids. In some embodiments, a peptide is chemically conjugated to a linker, reactive moiety, detection element (e.g., fluorophore), interaction/binding element, etc.

In some embodiments, provided herein are fusion polypeptides (e.g., genetic fusions, synthetically-produced fusions, chemical conjugates, enzymatic conjugates, etc.) comprising a peptide described in the preceding paragraph and an additional amino acid sequence. In some embodiments, the additional amino acid sequence is selected from the group consisting of a protein of interest, an interaction element, a co-localization element, and a binding moiety. In some embodiments, the additional amino acid sequence is a binding moiety selected from the group consisting of an antibody (polyclonal, monoclonal, and/or recombinant), antibody fragment, protein A, an Ig binding domain of protein A, protein G, an Ig binding domain of protein G, protein A/G, an Ig binding domain of protein A/G, protein L, a Ig binding domain of protein L, protein M, an Ig binding domain of protein M, peptide nucleic acid, DARPin, affimer, a purified protein (either the analyte itself or a protein that binds to the analyte), and analyte binding domain(s) of proteins. In some embodiments, the additional amino acid sequence is a first interaction polypeptide that is configured to form a complex with a second interaction polypeptide upon contact of the first interaction polypeptide and the second interaction polypeptide. In some embodiments, the additional amino acid sequence is a first co-localization polypeptide that is configured to co-localize within a cellular compartment, a cell, a tissue, or an organism within a with a second co-localization polypeptide. In some embodiments, the additional amino acid sequence is a protein of interest and is a candidate drug target.

In some embodiments, provided herein are compositions comprising: (a) a first peptide comprising an amino acid sequence having greater than 40% (e.g., 40%, 45%, 50%, 55%, 60%, 65%, 70%, 75%, 80%, 85%, 90%, 95%, or more), but less than 100% sequence identity with SEQ ID NO: 25 and less than 100% sequence identity with SEQ ID NO: 7 and SEQ ID NO: 10; and (b) a second peptide comprising an amino acid sequence having greater than 40% (e.g., 40%, 45%, 50%, 55%, 60%, 65%, 70%, 75%, 80%, 85%, 90%, 95%, or more), but less than 100% sequence identity with SEQ ID NO: 23 and less than 100% sequence identity with SEQ ID NO: 6, SEQ ID NO: 9, and SEQ ID NO: 29; wherein a bioluminescent signal produced in the presence of a coelenterazine or a coelenterazine analog substrate is substantially increased when the first peptide contacts the second peptide and a polypeptide complement consisting of SEQ ID NO: 17, SEQ ID NO: 21, or SEQ ID NO: 302 when compared to a bioluminescent signal produced by the first peptide and/or the second peptide and the coelenterazine substrate alone. In some embodiments, the bioluminescent signal is substantially increased when the first peptide associates with the second peptide and the polypeptide complement. In some embodiments, the first peptide exhibits enhancement of one or more traits compared to a peptide of SEQ ID NO: 7 and/or SEQ ID NO: 10, and the second peptide exhibits enhancement of one or more traits compared to a peptide of SEQ ID NO: 6, SEQ ID NO: 9, and SEQ ID NO: 29, wherein the traits are selected from: affinity for the second peptide and the polypeptide complement or enhanced expression, solubility, stability, and/or bioluminescent activity when combined with the second peptide and the polypeptide complement. In some embodiments, the amino acid sequence of the first and/or second peptide is not a naturally occurring protein or a fragment thereof. In some embodiments, the amino acid sequence of the first and/or second peptide contains a non-natural amino acid, an amino acid analog, and/or peptoid amino acids.

In some embodiments, provided herein are compositions comprising fusion polypeptides comprising the first and second peptides of described in the preceding paragraph and an additional amino acid sequence. In some embodiments, the additional amino acid sequence is selected from the group consisting of a protein of interest, an interaction element, a co-localization element, and a binding moiety. In some embodiments, the additional amino acid sequence is a binding moiety selected from the group consisting of an antibody (polyclonal, monoclonal, and/or recombinant), antibody fragment, protein A, an Ig binding domain of protein A, protein G, an Ig binding domain of protein G, protein A/G, an Ig binding domain of protein A/G, protein L, a Ig binding domain of protein L, protein M, an Ig binding domain of protein M, peptide nucleic acid, DARPin, affimer, a purified protein (either the analyte itself or a protein that binds to the analyte), and analyte binding domain(s) of proteins. In some embodiments, the additional amino acid sequence is a first interaction polypeptide that is configured to form a complex with a second interaction polypeptide upon contact of the first interaction polypeptide and the second interaction polypeptide. In some embodiments, the additional amino acid sequence is a first co-localization polypeptide that is configured to co-localize within a cellular compartment, a cell, a tissue, or an organism within a with a second co-localization polypeptide. In some embodiments, the additional amino acid sequence is a protein of interest and is a candidate drug target.

In some embodiments, provided herein are polypeptides comprising an amino acid sequence having 40% or greater (e.g., 40%, 45%, 50%, 55%, 60%, 65%, 70%, 75%, 80%, 85%, 90%, 95%, or more) sequence identity with SEQ ID NO: 17, SEQ ID NO: 21, or SEQ ID NO: 302 and less than 100% sequence identity with SEQ ID NO: 5 and SEQ ID NO: 8, wherein a bioluminescent signal produced in the presence of a coelenterazine or a coelenterazine analog substrate is substantially increased when the polypeptide contacts a first peptide consisting of SEQ ID NO: 23 and a second peptide consisting of SEQ ID NO: 25 when compared to a bioluminescent signal produced by the peptide and the coelenterazine or a coelenterazine analog substrate alone. In some embodiments, the bioluminescent signal is substantially increased when the polypeptide associates with the first and second peptides. In some embodiments, the polypeptide exhibits enhancement of one or more traits compared to a polypeptide of SEQ ID NO: 5 and/or SEQ ID NO: 8, wherein the traits are selected from: affinity for the first and/or second peptides or enhanced expression, solubility, stability, and/or bioluminescent activity when combined with the first and second peptides. In some embodiments, the amino acid sequence is not a naturally occurring protein (e.g., not SEQ ID NO: 1), not a mutant version thereof (e.g., not SEQ ID NO: 3), not a fragment of a naturally occurring protein (e.g., not SEQ ID NOS: 5-7), and not a fragment of a mutant version thereof (e.g., not one of SEQ ID NOS: 8-10). In some embodiments, the amino acid sequence contains a non-natural amino acid, an amino acid analog, and/or peptoid amino acids.

In some embodiments, provided herein are fusion polypeptides (e.g., genetic fusions, synthetically-produced fusions, chemical conjugates, enzymatic conjugates, etc.) comprising a polypeptide described in the preceding paragraph and an additional amino acid sequence, nucleic acid sequence, or other fused or appended molecule. In some embodiments, the additional sequence or other molecule is selected from the group consisting of a protein of interest, an interaction element, a co-localization element, and a binding moiety. In some embodiments, the additional sequence or other molecule is a binding moiety selected from the group consisting of an antibody (polyclonal, monoclonal, and/or recombinant), antibody fragment, protein A, an Ig binding domain of protein A, protein G, an Ig binding domain of protein G, protein A/G, an Ig binding domain of protein A/G, protein L, a Ig binding domain of protein L, protein M, an Ig binding domain of protein M, peptide nucleic acid, DARPin, affimer, a purified protein (either the analyte itself or a protein that binds to the analyte), and analyte binding domain(s) of proteins. In some embodiments, the additional sequence or other fused or appended molecule is a first interaction polypeptide that is configured to form a complex with a second interaction polypeptide upon contact of the first interaction polypeptide and the second interaction polypeptide. In some embodiments, the additional sequence or other fused or appended molecule is a first co-localization polypeptide that is configured to co-localize within a cellular compartment, a cell, a tissue, or an organism with a second co-localization polypeptide. In some embodiments, the additional sequence or other fused or appended molecule is a protein of interest and is a candidate drug target.

In some embodiments, provided herein are polypeptides comprising an amino acid sequence having 40% or greater (e.g., 40%, 45%, 50%, 55%, 60%, 65%, 70%, 75%, 80%, 85%, 90%, 95%, or more) sequence identity with SEQ ID NO: 17, SEQ ID NO: 21, and/or SEQ ID NO: 302 and less than 100% sequence identity with SEQ ID NO: 5 and SEQ ID NO: 8, wherein a bioluminescent signal produced in the presence of a coelenterazine or a coelenterazine analog substrate is substantially increased when the polypeptide contacts a first peptide consisting of SEQ ID NO: 23 and a second peptide consisting of SEQ ID NO: 25 when compared to a bioluminescent signal produced by the peptide and the coelenterazine or coelenterazine analog substrate alone. In some embodiments, the bioluminescent signal is substantially increased when the polypeptide associates with the first and second peptides. In some embodiments, the polypeptide exhibits enhancement of one or more traits compared to a polypeptide of SEQ ID NO: 5 and/or SEQ ID NO: 8, wherein the traits are selected from: affinity for the first and/or second peptides or enhanced expression, solubility, stability, and/or bioluminescent activity when combined with the first and second peptides. In some embodiments, the amino acid sequence is not a naturally occurring protein (e.g., not SEQ ID NO: 1), not a mutant version thereof (e.g., not SEQ ID NO: 3), not a fragment of a naturally occurring protein (e.g., not SEQ ID NOS: 5-7), and not a fragment of a mutant version thereof (e.g., not one of SEQ ID NOS: 8-10). In some embodiments, the amino acid sequence contains a non-natural amino acid, an amino acid analog, and/or peptoid amino acids.

In some embodiments, provided herein are fusion polypeptides (e.g., genetic fusions, synthetically-produced fusions, chemical conjugates, enzymatic conjugates, etc.) comprising a peptide described in the preceding paragraph and an additional amino acid sequence. In some embodiments, the additional amino acid sequence is selected from the group consisting of a protein of interest, an interaction element, a co-localization element, and a binding moiety. In some embodiments, the additional amino acid sequence is a binding moiety selected from the group consisting of an antibody (polyclonal, monoclonal, and/or recombinant), antibody fragment, protein A, an Ig binding domain of protein A, protein G, an Ig binding domain of protein G, protein A/G, an Ig binding domain of protein A/G, protein L, a Ig binding domain of protein L, protein M, an Ig binding domain of protein M, peptide nucleic acid, DARPin, affimer, a purified protein (either the analyte itself or a protein that binds to the analyte), and analyte binding domain(s) of proteins. In some embodiments, the additional amino acid sequence is a first interaction polypeptide that is configured to form a complex with a second interaction polypeptide upon contact of the first interaction polypeptide and the second interaction polypeptide. In some embodiments, the additional amino acid sequence is a first co-localization polypeptide that is configured to co-localize within a cellular compartment, a cell, a tissue, or an organism with a second co-localization polypeptide. In some embodiments, the additional amino acid sequence is a protein of interest and is a candidate drug target.

In some embodiments, provided herein are β9/β10-like dipeptides comprising an amino acid sequence having greater than 40% (e.g., 40%, 45%, 50%, 55%, 60%, 65%, 70%, 75%, 80%, 85%, 90%, 95%, or more), but less than 100% sequence identity with SEQ ID NO: 35 and less than 100% sequence identity with SEQ ID NO: 205 and SEQ ID NO: 206, wherein a bioluminescent signal produced in the presence of a coelenterazine or a coelenterazine analog substrate is substantially increased when the peptide contacts a polypeptide complement consisting of SEQ ID NO: 17, SEQ ID NO: 21, or SEQ ID NO: 302 when compared to a bioluminescent signal produced by the peptide and the coelenterazine or a coelenterazine analog substrate alone. In some embodiments, a dipeptide (e.g., $\beta_9/\beta_{10}$-like dipeptide) associates (e.g., forms a bioluminescent complex) with a polypeptide component described herein (e.g., $\beta_{1-8}$-like polypeptide) without facilitation (e.g., from interaction elements). In other embodiments, a dipeptide (e.g., $\beta_9/\beta_{10}$-like dipeptide) and polypeptide component described herein (e.g., $\beta_{1-8}$-like polypeptide) will not form a bioluminescent complex without facilitation (e.g., from interaction elements), but will associate (e.g., form a bioluminescent complex) with facilitation from appropriate interaction elements. In some embodiments, the bioluminescent signal is substantially increased when the peptide associates with the polypeptide complement. In some embodiments, the peptide exhibits enhancement of one or more traits compared to a peptide of SEQ ID NO: 205 and/or SEQ ID NO: 206, wherein the traits are selected from: affinity for the polypeptide complement or enhanced expression, solubility, stability, and/or bioluminescent activity when combined with the polypeptide complement. In some embodiments, the amino acid sequence is not a naturally occurring protein or a fragment thereof. In some embodiments, the amino acid sequence contains a non-natural amino acid, an amino acid analog, and/or peptoid amino acids.

In some embodiments, provided herein are fusion polypeptides (e.g., genetic fusions, synthetically-produced fusions, chemical conjugates, enzymatic conjugates, etc.) comprising the β9/β10-like dipeptides described herein and an additional amino acid sequence. In some embodiments, the additional amino acid sequence is selected from the group consisting of a protein of interest, an interaction element, a co-localization element, and a binding moiety. In some embodiments, the additional amino acid sequence or other fused or appended molecule is a binding moiety selected from the group consisting of antibody (polyclonal, monoclonal, and/or recombinant), antibody fragment, protein A, an Ig binding domain of protein A, protein G, an Ig binding domain of protein G, protein A/G, an Ig binding domain of protein A/G, protein L, a Ig binding domain of protein L, protein M, an Ig binding domain of protein M, peptide nucleic acid, DARPin, affimer, a purified protein (either the analyte itself or a protein that binds to the analyte), and analyte binding domain(s) of proteins. In some embodiments, the additional amino acid sequence or other fused or appended molecule is a first interaction polypeptide that is configured to form a complex with a second interaction polypeptide upon contact of the first interaction polypeptide and the second interaction polypeptide. In some embodiments, the additional amino acid sequence or other fused or appended molecule is a first co-localization polypeptide that is configured to co-localize within a cellular compartment, a cell, a tissue, or an organism with a second co-localization polypeptide. In some embodiments, the additional amino acid sequence or other fused or appended molecule is a protein of interest and is a candidate drug target.

In some embodiments, provided herein are nucleic acids and/or vectors coding for the peptides, polypeptides, and/or fusion polypeptides described herein. In some embodiments, provided herein are cells expressing nucleic acids and/or vectors coding for the peptides, polypeptides, and/or fusion polypeptides described herein. In some embodiments, synthetic production of the peptides, polypeptides, and/or fusion polypeptides described herein is provided. In some embodiments, the peptides, polypeptides, and/or fusion polypeptides described herein are chemically conjugated to additional moieties (e.g., interaction elements, co-localization elements, proteins of interest, molecules of interest, etc.).

In some embodiments, provided herein are bioluminescent complexes comprising: (a) a polypeptide comprising an amino acid sequence having 40% or greater (e.g., 40%, 45%, 50%, 55%, 60%, 65%, 70%, 75%, 80%, 85%, 90%, 95%, or more) sequence identity with SEQ ID NO: 17, SEQ ID NO: 21, or SEQ ID NO: 302 and less than 100% sequence identity with SEQ ID NO: 5 and SEQ ID NO: 8; (b) a first peptide comprising an amino acid sequence having 40% or greater (e.g., 40%, 45%, 50%, 55%, 60%, 65%, 70%, 75%, 80%, 85%, 90%, 95%, or more) sequence identity with SEQ ID NO: 23 and less than 100% sequence identity with SEQ ID NO: 6 and SEQ ID NO: 9; and (c) a second peptide comprising an amino acid sequence having 40% or greater (e.g., 40%, 45%, 50%, 55%, 60%, 65%, 70%, 75%, 80%, 85%, 90%, 95%, or more) sequence identity with SEQ ID NO: 25 and less than 100% sequence identity with SEQ ID NO: 7 and SEQ ID NO: 10; wherein the bioluminescent complex produces substantially increased bioluminescence in the presence of a coelenterazine or a coelenterazine analog substrate when compared to a coelenterazine or a coelenterazine analog substrate in the presence of: the polypeptide alone, the first peptide alone, the second peptide alone, and any two of the polypeptide, the first peptide, and the second peptide. In some embodiments, the first peptide is a first peptide tag, wherein the second peptide is a second peptide tag, and wherein the first and second peptide tags are each linked to moieties that are independently selected from the group consisting of a molecule of interest, a peptide of interest, a protein of interest, an interaction element, a co-localization element, or a binding moiety. In some embodiments, the first peptide tag or the second peptide tag is linked to a drug or drug candidate, and the other peptide tag is linked to a drug target or candidate drug target, and wherein the intensity of the bioluminescence from the bioluminescent complex correlates to the affinity of the drug or drug candidate for the drug target or candidate drug target. In some embodiments, the first peptide tag is linked to a first interaction element, and the second peptide tag is linked to a second interaction element, and wherein the intensity of the bioluminescence from the bioluminescent complex correlates to the affinity of the first interaction element for the second interaction element under the conditions assayed (e.g., in some embodiments, the combination of the first peptide, second peptide, polypeptide component, and substrate do not form the bioluminescent complex (and produce significant light output (e.g., above background)) in the absence of an interaction between interaction elements). In some embodiments, the first peptide tag is linked to a first co-localization element, and the second peptide tag is linked to a second co-localization element, and wherein substantially increased bioluminescence indicates co-localization, but not necessarily interaction, of the first co-localization element and the second co-localization element, under the conditions assayed.

In some embodiments, the peptides and polypeptide provided herein are not fragments of larger (e.g., pre-existing) proteins. In other embodiments, one or more peptides and/or polypeptides provided herein are fragments of larger (e.g., pre-existing) proteins.

In some embodiments, provided herein are methods comprising: (a) combining: (i) a first peptide comprising an amino acid sequence having 40% or greater (e.g., 40%, 45%, 50%, 55%, 60%, 65%, 70%, 75%, 80%, 85%, 90%, 95%, or more) sequence identity with SEQ ID NO: 23 and less than 100% sequence identity with SEQ ID NO: 6 and SEQ ID NO: 9, (ii) a second peptide comprising an amino acid sequence having 40% or greater (e.g., 40%, 45%, 50%, 55%, 60%, 65%, 70%, 75%, 80%, 85%, 90%, 95%, or more) sequence identity with SEQ ID NO: 25 and less than 100% sequence identity with SEQ ID NO: 7 and SEQ ID NO: 10, (iii) a polypeptide component comprising an amino acid sequence having 40% or greater (e.g., 40%, 45%, 50%, 55%, 60%, 65%, 70%, 75%, 80%, 85%, 90%, 95%, or more) sequence identity with SEQ ID NO: 17, SEQ ID NO: 21, or SEQ ID NO: 302 and less than 100% sequence identity with SEQ ID NO: 5 and SEQ ID NO: 8, wherein the first peptide tag, the second peptide tag, and the polypeptide component are configured to produce a bioluminescent complex upon interaction of the first molecular entity and the second molecular entity, and (iv) a coelenterazine or a coelenterazine analog substrate; and (b) detecting luminescence, wherein a greater level of luminescence compared to a level of luminescence produced by the polypeptide component and a coelenterazine or a coelenterazine analog alone indicates formation of a bioluminescent complex of the polypeptide component and the first and second peptides. In some embodiments, one or more of the polypeptide component and the first and second peptides are expressed in a cell, added to a cell exogenously, and/or added to a sample.

In some embodiments, provided herein are methods of detecting an interaction between a first molecular entity and a second molecular entity, the method comprising: (a) tagging the first molecular entity with a first peptide tag comprising an amino acid sequence having 40% or greater (e.g., 40%, 45%, 50%, 55%, 60%, 65%, 70%, 75%, 80%, 85%, 90%, 95%, or more) sequence identity with SEQ ID NO: 23 and less than 100% sequence identity with SEQ ID NO: 6 and SEQ ID NO: 9; (b) tagging the second molecular entity with a second peptide tag comprising an amino acid sequence having 40% or greater (e.g., 40%, 45%, 50%, 55%, 60%, 65%, 70%, 75%, 80%, 85%, 90%, 95%, or more) sequence identity with SEQ ID NO: 25 and less than 100% sequence identity with SEQ ID NO: 7 and SEQ ID NO: 10; (c) combining the tagged first molecular entity and the tagged second molecular entity; (d) adding a polypeptide component comprising an amino acid sequence having 40% or greater (e.g., 40%, 45%, 50%, 55%, 60%, 65%, 70%, 75%, 80%, 85%, 90%, 95%, or more) sequence identity with SEQ ID NO: 17, SEQ ID NO: 21, or SEQ ID NO: 302 and less than 100% sequence identity with SEQ ID NO: 5 and SEQ ID NO: 8, wherein the first peptide tag, the second peptide tag, and the polypeptide component are configured to produce a bioluminescent complex upon interaction of the first molecular entity and the second molecular entity; (e) adding a coelenterazine or a coelenterazine analog substrate; and (f) detecting a luminescent signal produced by the bioluminescent complex, wherein the magnitude of the luminescent signal correlates with (e.g., is proportional to, is directly proportional to, etc.) the number of, strength of, favorability of, and/or stability of the interaction(s)) between the first molecular entity and the second molecular entity. In some embodiments, catalytic efficiency, substrate turnover, and/or specific activity of the resulting bioluminescent complex correlates with (e.g., is proportional to, is directly proportional to, etc.) the number of, strength of, favorability of, and/or stability of the interaction(s)) between the first molecular entity and the second molecular entity. In some embodiments, the first molecular entity and/or the second molecular entity is a protein of interest or a peptide of interest, and tagging comprises generating a fusion (or synthetic conjugation) of the first molecular entity and/or the second molecular entity with the first peptide tag and/or second peptide tag. In some embodiments, the first molecular entity and/or the second molecular entity is a small molecule, and tagging comprises directly or indirectly linking the first molecular entity and/or the second molecular entity with the first peptide tag and/or second peptide tag. In some embodiments, one of the first molecular entity and the second molecular entity is a drug or drug candidate, and the other is a drug target or candidate drug target, and the bioluminescent signal indicates binding of the drug or drug candidate to the other is a drug target or candidate drug target. In some embodiments, combining the tagged first molecular entity and the tagged second molecular entity comprises expressing one or both within a cell and/or adding one or both to a cell. In some embodiments, combining the tagged first molecular entity and the tagged second molecular entity is performed in vitro, in a non-cellular sample, etc. In some embodiments, the affinity of a drug or candidate drug for a drug target or candidate drug target is determined using the systems and methods herein by titrating unlabeled drug target or candidate drug target into the system. In some embodiments, two or more of steps (a)-(f) are performed concurrently. In some embodiments, two or more of steps (a)-(f) are performed separately.

In some embodiments, provided herein are method of performing a competition assay to detect an interaction between a first molecular entity and a second molecular entity, the method comprising: (a) combining: (i) a tracer comprising the first molecular entity tagged with a first peptide tag comprising an amino acid sequence having 40% or greater (e.g., 40%, 45%, 50%, 55%, 60%, 65%, 70%, 75%, 80%, 85%, 90%, 95%, or more) sequence identity with SEQ ID NO: 23 and less than 100% sequence identity with SEQ ID NO: 6 and SEQ ID NO: 9, (ii) the second molecular entity tagged with a second peptide tag comprising an amino acid sequence having 40% or greater (e.g., 40%, 45%, 50%, 55%, 60%, 65%, 70%, 75%, 80%, 85%, 90%, 95%, or more) sequence identity with SEQ ID NO: 25 and less than 100% sequence identity with SEQ ID NO: 7 and SEQ ID NO: 10, (iii) a coelenterazine or a coelenterazine analog substrate, (iv) a polypeptide component comprising an amino acid sequence having 40% or greater (e.g., 40%, 45%, 50%, 55%, 60%, 65%, 70%, 75%, 80%, 85%, 90%, 95%, or more) sequence identity with SEQ ID NO: 17, SEQ ID NO: 21, or SEQ ID NO: 302 and less than 100% sequence identity with SEQ ID NO: 5 and SEQ ID NO: 8, and (v) a sample suspected of containing untagged first molecular entity; wherein the first peptide tag, the second peptide tag, and the polypeptide component are configured to produce a bioluminescent complex and produce a bioluminescent signal in the presence of the coelenterazine or a coelenterazine analog substrate; (b) detecting the bioluminescent signal produced by the bioluminescent complex; and (c) comparing the bioluminescent signal produced in the presence of the sample with a control bioluminescent signal produced in the absence of the sample, wherein a decrease in the bioluminescent signal indicates the presence or amount of untagged first molecular entity in the sample. In some embodiments, the first molecular entity is a small molecule or peptide (e.g., drug or candidate drug). In some embodiments, the second molecular entity is a drug target or candidate drug target (e.g., a protein).

In some embodiments, provided herein are methods of detecting an interaction between a first protein, peptide, or molecular entity and a second protein, peptide, or molecular entity within a cell comprising, the method comprising: (a) expressing within the cell (or adding to a cell or other system (e.g., non-cellular sample)), a fusion (e.g., genetic fusion, synthetic fusion, chemical conjugation, etc.) comprising the first protein, peptide, or molecular entity and a first peptide tag comprising an amino acid sequence having 40% or greater (e.g., 40%, 45%, 50%, 55%, 60%, 65%, 70%, 75%, 80%, 85%, 90%, 95%, or more) sequence identity with SEQ ID NO: 23 and less than 100% sequence identity with SEQ ID NO: 6 and SEQ ID NO: 9; (b) expressing within the cell (or adding to a cell or other system (e.g., non-cellular sample)), a fusion (e.g., genetic fusion, synthetic fusion, chemical conjugation, etc.) comprising the second protein, peptide, or molecular entity and a second peptide tag comprising an amino acid sequence having 40% or greater (e.g., 40%, 45%, 50%, 55%, 60%, 65%, 70%, 75%, 80%, 85%, 90%, 95%, or more) sequence identity with SEQ ID NO: 25 and less than 100% sequence identity with SEQ ID NO: 7 and SEQ ID NO: 10; (c) expressing with the cell (or adding to a cell or other system (e.g., non-cellular sample)), a polypeptide component comprising an amino acid sequence having 40% or greater (e.g., 40%, 45%, 50%, 55%, 60%, 65%, 70%, 75%, 80%, 85%, 90%, 95%, or more) sequence identity with SEQ ID NO: 17, SEQ ID NO: 21, or SEQ ID NO: 302 and less than 100% sequence identity with SEQ ID NO: 5 and SEQ ID NO: 8, wherein the first peptide tag, the second peptide tag, and the polypeptide component are configured to produce a bioluminescent complex upon interaction of the first protein, peptide, or molecular entity and the second protein, peptide, or molecular entity; (d) adding a coelenterazine or a coelenterazine analog substrate to the cell; and (e) detecting a luminescent signal produced by the bioluminescent complex, wherein the magnitude of the luminescent signal correlates to the strength of the interaction between the first protein, peptide, or molecular entity and the second protein, peptide, or molecular entity. In some embodiments, two or more of steps (a)-(e) are performed concurrently. In some embodiments, two or more of steps (a)-(e) are performed separately.

In some embodiments, provided herein are methods of detecting co-localization of a first molecular entity and a second molecular entity, the method comprising: (a) tagging the first molecular entity with a first peptide tag comprising an amino acid sequence having 40% or greater (e.g., 40%, 45%, 50%, 55%, 60%, 65%, 70%, 75%, 80%, 85%, 90%, 95%, or more) sequence identity with SEQ ID NO: 23 and less than 100% sequence identity with SEQ ID NO: 6 and SEQ ID NO: 9; (b) tagging the second molecular entity with a second peptide tag comprising an amino acid sequence having 40% or greater (e.g., 40%, 45%, 50%, 55%, 60%, 65%, 70%, 75%, 80%, 85%, 90%, 95%, or more) sequence identity with SEQ ID NO: 25 and less than 100% sequence identity with SEQ ID NO: 7 and SEQ ID NO: 10; (c) combining the tagged first molecular entity and the tagged second molecular entity in the same system; (d) adding a polypeptide component to the system, the polypeptide components comprising an amino acid sequence having 40% or greater (e.g., 40%, 45%, 50%, 55%, 60%, 65%, 70%, 75%, 80%, 85%, 90%, 95%, or more) sequence identity with SEQ ID NO: 17, SEQ ID NO: 21, or SEQ ID NO: 302 and less than 100% sequence identity with SEQ ID NO: 5 and SEQ ID NO: 8, wherein the first peptide tag, the second peptide tag, and the polypeptide component are configured to produce a bioluminescent complex upon co-localization of the first molecular entity and the second molecular entity; (e) adding a coelenterazine or a coelenterazine analog substrate to the system; and (f) detecting a luminescent signal produced by the bioluminescent complex, wherein the presence of luminescent signal above background indicates co-localization of the first molecular entity and the second molecular entity within the system, and/or wherein the magnitude of the luminescent signal correlates to the amount of co-localization within the system of the first molecular entity and the second molecular entity. In some embodiments, the system comprises a cell, tissue, organ, or whole organism. In some embodiments, the first molecular entity and/or the second molecular entity is a protein of interest or a peptide of interest, and tagging comprises generating a fusion (e.g., genetic fusion, synthetic fusion, chemical conjugation, enzymatic conjugation, etc.) of the first molecular entity and/or the second molecular entity with the first peptide tag and/or second peptide tag. In some embodiments, the first molecular entity and/or the second molecular entity is a small molecule and tagging comprises directly or indirectly linking the first molecular entity and/or the second molecular entity with the first peptide tag and/or second peptide tag. In some embodiments, combining the tagged first molecular entity and the tagged second molecular entity is performed in vitro, in a non-cellular sample, etc. In some embodiments, combining the tagged first molecular entity and the tagged second molecular entity comprises expressing one or both within the system and/or adding one or both to the system. In some embodiments, two or more of steps (a)-(f) are performed concurrently. In some embodiments, two or more of steps (a)-(f) are performed separately.

In some embodiments, provided herein are methods of detecting co-localization of a first protein, peptide, or molecular entity and a second protein, peptide, or molecular entity within a cell the method comprising: (a) expressing within the cell a fusion comprising the first protein or peptide entity and a first peptide tag comprising an amino acid sequence having 40% or greater (e.g., 40%, 45%, 50%, 55%, 60%, 65%, 70%, 75%, 80%, 85%, 90%, 95%, or more) sequence identity with SEQ ID NO: 23 and less than 100% sequence identity with SEQ ID NO: 6 and SEQ ID NO: 9; (b) expressing within the cell a fusion comprising the second protein or peptide entity and a second peptide tag comprising an amino acid sequence having 40% or greater (e.g., 40%, 45%, 50%, 55%, 60%, 65%, 70%, 75%, 80%, 85%, 90%, 95%, or more) sequence identity with SEQ ID NO: 25 and less than 100% sequence identity with SEQ ID NO: 7 and SEQ ID NO: 10; (c) expressing with the cell a polypeptide component comprising an amino acid sequence having 40% or greater (e.g., 40%, 45%, 50%, 55%, 60%, 65%, 70%, 75%, 80%, 85%, 90%, 95%, or more) sequence identity with SEQ ID NO: 17, SEQ ID NO: 21, and/or SEQ ID NO: 302 and less than 100% sequence identity with SEQ ID NO: 5 and SEQ ID NO: 8, wherein the first peptide tag, the second peptide tag, and the polypeptide component are configured to produce a bioluminescent complex upon co-localization of the first protein or peptide entity and the second protein or peptide entity; (d) adding a coelenterazine or a coelenterazine analog substrate to the cell; and (e) detecting a luminescent signal produced by the bioluminescent complex, wherein the presence of luminescent signal above background indicates co-localization of the first protein or peptide entity and the second protein or peptide entity within the cell, and/or wherein the magnitude of the luminescent signal correlates to the amount of co-localization within the system of the first protein or peptide entity and the second protein or peptide entity. In some embodiments, two or more of steps (a)-(e) are performed concurrently. In some embodiments, two or more of steps (a)-(e) are performed separately.

In some embodiments, provided herein are kits comprising: (a) a first binding moiety conjugated to a first peptide tag comprising an amino acid sequence having 40% or greater (e.g., 40%, 45%, 50%, 55%, 60%, 65%, 70%, 75%, 80%, 85%, 90%, 95%, or more) sequence identity with SEQ ID NO: 23 and less than 100% sequence identity with SEQ ID NO: 6 and SEQ ID NO: 9; and (b) a second binding moiety conjugated to second peptide tag comprising an amino acid sequence having 40% or greater (e.g., 40%, 45%, 50%, 55%, 60%, 65%, 70%, 75%, 80%, 85%, 90%, 95%, or more) sequence identity with SEQ ID NO: 25 and less than 100% sequence identity with SEQ ID NO: 7 and SEQ ID NO: 10. In some embodiments, the first and second binding moieties are independently selected from the group consisting of an antibody (e.g., polyclonal, monoclonal, and/or recombinant), antibody fragment, protein A, an Ig binding domain of protein A, protein G, an Ig binding domain of protein G, protein A/G, an Ig binding domain of protein A/G, protein L, an Ig binding domain of protein L, protein M, an Ig binding domain of protein M, oligonucleotide probe, peptide nucleic acid, DARPin, aptamer, affimer, a purified protein (either the analyte itself or a protein that binds to the analyte), and analyte binding domain(s) of proteins. In some embodiments, the first and second binding moieties are primary binding moieties configured to bind to antigens, epitopes, or sequences on the same target entity. In some embodiments, the first and second binding moieties are secondary binding moieties configured to bind to antigens, epitopes, or sequences on primary binding moieties. In some embodiments, kits further comprise a polypeptide reagent comprising an amino acid sequence having 40% or greater (e.g., 40%, 45%, 50%, 55%, 60%, 65%, 70%, 75%, 80%, 85%, 90%, 95%, or more) sequence identity with SEQ ID NO: 17, SEQ ID NO: 21, and/or SEQ ID NO: 302 and less than 100% sequence identity with SEQ ID NO: 5 and SEQ ID NO: 8. In some embodiments, kits further comprise a coelenterazine or a coelenterazine analog.

In some embodiments, provided herein are methods of detecting a target molecule, wherein the target molecule displays a first antigen, epitope, or sequence and a distinct second antigen, epitope, or sequence the method comprising: (a) contacting a sample containing the target molecule with (i) a first primary binding moiety that recognizes the first antigen, epitope, or sequence and (ii) a second primary binding moiety that recognizes the second antigen, epitope, or sequence and allowing the first and second primary binding moieties to bind to the first and second antigens, epitopes, or sequences; (b) contacting the sample with (i) a first secondary binding moiety conjugated or fused to a first peptide tag and (ii) a second secondary binding moiety conjugated or fused to second peptide tag, wherein the first secondary binding moiety recognizes the first primary binding moiety and the second secondary binding moiety recognizes the second primary binding moiety, wherein the first or second peptide tag comprises an amino acid sequence having 40% or greater (e.g., 40%, 45%, 50%, 55%, 60%, 65%, 70%, 75%, 80%, 85%, 90%, 95%, or more) sequence identity with SEQ ID NO: 23 (and less than 100% sequence identity with SEQ ID NO: 6 and SEQ ID NO: 9), and wherein the other of the first or second peptide tag comprises an amino acid sequence having 40% or greater (e.g., 40%, 45%, 50%, 55%, 60%, 65%, 70%, 75%, 80%, 85%, 90%, 95%, or more) sequence identity with SEQ ID NO: 25 (and less than 100% sequence identity with SEQ ID NO: 7 and SEQ ID NO: 10) and allowing the first and second secondary binding moieties to bind to the first and second primary binding moieties; (c) contacting the sample with comprising an polypeptide component having 40% or greater (e.g., 40%, 45%, 50%, 55%, 60%, 65%, 70%, 75%, 80%, 85%, 90%, 95%, or more) sequence identity with SEQ ID NO: 17, SEQ ID NO: 21, and/or SEQ ID NO: 302 (and less than 100% sequence identity with SEQ ID NO: 5 and SEQ ID NO: 8), wherein the first peptide tag, the second peptide tag, and the polypeptide component are configured to produce a bioluminescent complex upon interaction; (d) contacting the sample with a coelenterazine or a coelenterazine analog substrate; and (e) detecting a luminescent signal produced by the bioluminescent complex, wherein the presence of luminescent signal above background indicates the presence of the target molecule, and/or wherein the magnitude of the luminescent signal correlates to the amount of target molecule within the sample. In some embodiments, the binding moieties are independently selected from the group consisting of an antibody (polyclonal, monoclonal, and/or recombinant), antibody fragment, protein A, an Ig binding domain of protein A, protein G, an Ig binding domain of protein G, protein A/G, an Ig binding domain of protein A/G, protein L, an Ig binding domain of protein L, protein M, an Ig binding domain of protein M, oligonucleotide probe, peptide nucleic acid, DARPin, aptamer, affimer, a purified protein (either the analyte itself or a protein that binds to the analyte), and analyte binding domain(s) of proteins. In some embodiments, the target molecule is a protein, peptide, nucleic acid, chemical, or drug. In some embodiments, the sample is in vitro or in vivo.

In some embodiments, provided herein are methods of detecting a target molecule, wherein the target molecule displays a first antigen, epitope, or sequence and a distinct second antigen, epitope, or sequence, the method comprising: (a) contacting the sample with (i) a first binding moiety conjugated or fused to a first peptide tag and (ii) a second binding moiety conjugated or fused to second peptide tag, wherein the first binding moiety recognizes the first antigen, epitope, or sequence and the second binding moiety recognizes the second antigen, epitope, or sequence, wherein the first or second peptide tag comprises an amino acid sequence having 40% or greater (e.g., 40%, 45%, 50%, 55%, 60%, 65%, 70%, 75%, 80%, 85%, 90%, 95%, or more) sequence identity with SEQ ID NO: 23 (and less than 100% sequence identity with SEQ ID NO: 6 and SEQ ID NO: 9), and wherein the other of the first or second peptide tag comprises an amino acid sequence having 40% or greater (e.g., 40%, 45%, 50%, 55%, 60%, 65%, 70%, 75%, 80%, 85%, 90%, 95%, or more) sequence identity with SEQ ID NO: 25 (and less than 100% sequence identity with SEQ ID NO: 7 and SEQ ID NO: 10) and allowing the first and second binding moieties to bind to the first and second antigens, epitopes, or sequences; (c) contacting the sample with a polypeptide component having 40% or greater (e.g., 40%, 45%, 50%, 55%, 60%, 65%, 70%, 75%, 80%, 85%, 90%, 95%, or more) sequence identity with SEQ ID NO: 17, SEQ ID NO: 21, and/or SEQ ID NO: 302 (and less than 100% sequence identity with SEQ ID NO: 5 and SEQ ID NO: 8), wherein the first peptide tag, the second peptide tag, and the polypeptide component are configured to produce a bioluminescent complex upon interaction; (d) contacting the sample with a coelenterazine or a coelenterazine analog substrate; and (e) detecting a luminescent signal produced by the bioluminescent complex, wherein the presence of luminescent signal above background indicates the presence of the target molecule, and/or wherein the magnitude of the luminescent signal correlates to the amount of target molecule within the sample. In some embodiments, the binding moieties are independently selected from the group consisting of an antibody (polyclonal, monoclonal, and/or recombinant), antibody fragment, protein A, an Ig binding domain of protein A, protein G, an Ig binding domain of protein G, protein A/G, an Ig binding domain of protein A/G, protein L, an Ig binding domain of protein L, protein M, an Ig binding domain of protein M, oligonucleotide probe, peptide nucleic acid, DARPin, aptamer, affimer, a purified protein (either the analyte itself or a protein that binds to the analyte), and analyte binding domain(s) of proteins. In some embodiments, the target molecule is a protein, peptide, nucleic acid, chemical, or drug. In some embodiments, the sample is in vitro or in vivo.

In some embodiments, provided herein are methods comprising: (a) combining: (i) a peptide component comprising an amino acid sequence having 40% or greater (e.g., 40%, 45%, 50%, 55%, 60%, 65%, 70%, 75%, 80%, 85%, 90%, 95%, or more) sequence identity with SEQ ID NO: 35 and less than 100% sequence identity with SEQ ID NO: 205 and SEQ ID NO: 206, (ii) a polypeptide component comprising an amino acid sequence having 40% or greater (e.g., 40%, 45%, 50%, 55%, 60%, 65%, 70%, 75%, 80%, 85%, 90%, 95%, or more) sequence identity with SEQ ID NO: 17, SEQ ID NO: 21, and/or SEQ ID NO: 302 and less than 100% sequence identity with SEQ ID NO: 5 and SEQ ID NO: 8, and (iii) a coelenterazine or a coelenterazine analog substrate, wherein the peptide component and the polypeptide component are configured to produce a bioluminescent complex upon interaction; and (b) detecting luminescence, wherein a greater level of luminescence compared to a level of luminescence produced by the polypeptide component and a coelenterazine or a coelenterazine analog alone indicates formation of a bioluminescent complex of the polypeptide component with the peptide. In some embodiments, the peptide is a fusion (e.g., genetic, synthetic, chemical conjugate, enzymatic conjugate, etc.) with a first interaction element, and the polypeptide component is a fusion (e.g., genetic, synthetic, chemical conjugate, enzymatic conjugate, etc.) with a second interaction element, wherein the peptide and the polypeptide component form a bioluminescent complex upon interaction of the interaction elements, but do not form a bioluminescent complex in the absence of an interaction between the interaction elements. In some embodiments, the peptide and the polypeptide component form a bioluminescent complex in the absence of facilitation (e.g., by interaction elements. In some embodiments, the peptide is a fusion or conjugate (e.g., genetic, synthetic, chemical conjugate, enzymatic conjugate, etc.) with a protein, peptide, or molecule of interest (e.g., not an interaction element) and/or the polypeptide component is a fusion or conjugate (e.g., genetic, synthetic, chemical conjugate, enzymatic conjugate, etc.) with a protein, peptide, or molecule of interest (e.g., not an interaction element). In some embodiments, the peptide component and the polypeptide component form a bioluminescent complex upon co-localization (e.g., in a sample, in a cell, in a tissue, in a subject, etc.) without facilitation by interaction elements. In some embodiments, the peptide component and the polypeptide component form a bioluminescent complex upon facilitation by interaction elements but not without facilitation.

In some embodiments, provided herein are compositions comprising a monomeric polypeptide comprising an amino acid sequence with greater than 40% (e.g., 40%, 45%, 50%, 55%, 60%, 65%, 70%, 75%, 80%, 85%, 90%, 95%, 100%, or ranges therebetween), but less than 100% sequence identity with SEQ ID NO: 788 or 789 and less than 100% sequence identity with SEQ ID NO: 1 or 3; wherein the polypeptide exhibits luminescence in the presence of a coelenterazine or a coelenterazine analog substrate. In some embodiments, the peptide comprising an amino acid sequence with greater than 40% (e.g., 40%, 45%, 50%, 55%, 60%, 65%, 70%, 75%, 80%, 85%, 90%, 95%, 100%, or ranges therebetween) sequence identity with one or more of SEQ ID NOS: 780, 782, 784, 786, 802, 804, 806, 808, 813, 815, or 829. In some embodiments, the polypeptide further comprises an additional amino acid sequence. In some embodiments, fusion proteins of the polypeptides described herein are provided.

In some embodiments, provided herein are nucleic acids comprising a sequence coding for a comprising an amino acid sequence with greater than 40% (e.g., 40%, 45%, 50%, 55%, 60%, 65%, 70%, 75%, 80%, 85%, 90%, 95%, 100%, or ranges therebetween), but less than 100% sequence identity with SEQ ID NO: 788 or 789 and less than 100% sequence identity with SEQ ID NO: 1 or 3; wherein the polypeptide exhibits luminescence in the presence of a coelenterazine or a coelenterazine analog substrate. In some embodiments, a nucleic acid codes for an amino acid sequence with greater than 40% (e.g., 40%, 45%, 50%, 55%, 60%, 65%, 70%, 75%, 80%, 85%, 90%, 95%, 100%, or ranges therebetween) sequence identity with one or more of SEQ ID NOS: 780, 782, 784, 786, 802, 804, 806, 808, 813, 815, or 829. In some embodiments, nucleic acids coding for fusion proteins of the polypeptides described herein are provided.

In some embodiments, provided herein are methods of detecting bioluminescence comprising contacting a monomeric bioluminescent polypeptide described herein with a coelenterazine or a coelenterazine analog substrate and detecting luminescence.

In some embodiments, provided herein are polypeptides comprising an amino acid sequence with greater than 40% sequence identity with SEQ ID NO: 15 linked to the N-terminal end of an amino acid sequence with greater than 40% sequence identity with one of SEQ ID NOS: 17, 21, or 302; wherein a bioluminescent signal produced in the presence of a coelenterazine or a coelenterazine analog substrate is substantially increased when the polypeptide contacts a peptide or polypeptide comprising an amino acid sequence consisting of SEQ ID NO: 23 when compared to a bioluminescent signal produced by the polypeptide and the coelenterazine substrate alone. In some embodiments, nucleic acids comprising a sequence coding for the polypeptides described herein are provided. In some embodiments, fusions of the polypeptides described herein and additional amino acid sequences are provided.

In some embodiments, provided herein are methods comprising (a) contacting a polypeptide comprising an amino acid sequence with greater than 40% sequence identity with SEQ ID NO: 15 linked to the N-terminal end of an amino acid sequence with greater than 40% sequence identity with one of SEQ ID NOS: 17, 21, or 302 with a coelenterazine or a coelenterazine analog substrate and a peptide or polypeptide comprising an amino acid sequence with 40% or greater (e.g., 40%, 45%, 50%, 55%, 60%, 65%, 70%, 75%, 80%, 85%, 90%, 95%, 100%, or ranges therebetween) sequence identity with SEQ ID NO: 23; and (b) detecting luminescence.

In some embodiments, provided herein are systems comprising: (a) a sensor polypeptide comprising a first amino acid sequence having at least 40% (e.g., 40%, 45%, 50%, 55%, 60%, 65%, 70%, 75%, 80%, 85%, 90%, 95%, 100%, or ranges therebetween) sequence identity with SEQ ID NO: 11 linked to an amino acid sequence that localizes in a specific cellular location; and (b) a protein of interest linked to a peptide tag comprising an amino acid sequence having at least 40% (e.g., 40%, 45%, 50%, 55%, 60%, 65%, 70%, 75%, 80%, 85%, 90%, 95%, 100%, or ranges therebetween) sequence identity to SEQ ID NO: 23; wherein a bioluminescent complex is formed between the polypeptide and the peptide tag upon colocalization within the specific cellular location. In some embodiments, the specific cellular location is selected from plasma membrane, nucleus, mitochondria, and the endoplasmic reticulum. In some embodiments, provided herein are methods comprising (a) expressing a system described herein in a cell; (b) contacting the cell with a coelenterazine or a coelenterazine analog substrate; and (c) detecting luminescence, wherein an increase in luminescence indicates formation of the bioluminescent complex and co-localization of the polypeptide and peptide tag. In some embodiments, the method further comprises a step of inducing translocation protein of interest linked to a peptide tag to the specific cellular location.

BRIEF DESCRIPTION OF THE DRAWINGS

FIG. 36. Table depicting a biochemical analysis of β9-like peptide (SmTrip9 peptides) length influence on β9-like peptide affinity and maximum light output with LgTrip 3546 (SEQ ID NO: 51) and SmTrip10 pep86.

FIG. 37. Table depicting a biochemical analysis of β9-like peptide (SmTrip9 peptides) length influence on HiBiT affinity and maximum light output with LgTrip 3546 (SEQ ID NO: 51) and SmTrip10 pep86 (SEQ ID NO: 25).

FIG. 38. Table depicting Kd and Bmax of β9-like SmTrip9 pep286 (SEQ ID NO: 37) point mutants with LgTrip 3546 (SEQ ID NO: 51) and SmTrip10 pep86 (SEQ ID NO: 25).

FIG. 39. Table depicting the effect of various solubility tags on β9-like peptide affinity with LgTrip 3546 (SEQ ID NO: 51) and SmTrip9 pep286 (SEQ ID NO: 37).

FIG. 40. Table depicting the effect of various C-terminal extension sequences on β9-like or β10-like peptide affinity and maximum light output. β9-like peptide titrations (pep286 (SEQ ID NO: 37), pep292 (SEQ ID NO: 153), pep297 (SEQ ID NO: 157), pep302 (SEQ ID NO: 161)) and β10-like peptide SmTrip10 pep86 (HiBiT; SEQ ID NO: 25) are depicted.

FIG. 51E-H. Schematic illustrations depicting exemplary immunoassays using components and reagents described herein: (A) direct immunoassay, (B) indirect immunoassay, (C) competition direct immunoassay, and (D) competition indirect immunoassay.

FIG. 74. Table listing affinity and Bmax of synthetic SmTrip9 solubility variants with C-terminal extensions. (LgTrip 3546 (SEQ ID NO: 51)).

FIG. 75. Table listing affinity and Bmax of synthetic SmTrip9 solubility variants with C-terminal extensions. (LgTrip 3546 (SEQ ID NO: 51)).

FIG. 76. Table listing Kd and Bmax of synthetic SmTrip9 variants with differentially blocked termini. (LgTrip 3546 (SEQ ID NO: 51)).

FIG. 77A-B. Table listing the solubility of synthetic SmTrip9 peptides.

FIG. 82. Table listing results of titration of various SmTrip10 peptides in the presence of constant SmTrip9 pep286 (SEQ ID NO: 37) and LgTrip 3546 (SEQ ID NO: 51).

FIG. 83. Table listing results of titration of various SmTrip10 peptides in the presence of constant SmTrip9 pep286 (SEQ ID NO: 37) and LgTrip 3546 (SEQ ID NO: 51) titration FIG. 84. Graph depicting bioluminescence from Antares-type fusions (LgTrip 3546) with SmTrip9 pep263 (SEQ ID NO: 35) and SmTrip10 pep86 (SEQ ID NO: 25) or SmTrip10 pep86+SmTrip9 pep286 (SEQ ID NO: 37).

FIG. 86. Graphs depicting titration of LgBiT (SEQ ID NO: 11) and LgTrip 3546 (SEQ ID NO: 51) with "dark" dipeptide 272 (SEQ ID NO: 146) in the presence of dipeptide pep263 (SEQ ID NO: 35).

FIG. 87. Graphs comparing the inhibition of dark dipeptides 272 (SEQ ID NO: 146) and 273 (SEQ ID NO: 298) with LgTrip 3546 (SEQ ID NO: 51) and LgBiT (SEQ ID NO: 11).

FIG. 92. Table depicting the results of a FRB-FKBP assay screen with SmTrip9 s 823 and 840.

FIG. 93. Table listing Kd and Bmax of synthetic SmTrip9 pep435 (SEQ ID NO: 231) and SmTrip9 pep434 (SEQ ID NO: 230) variants with LgTrip 3546 (SEQ ID NO: 51).

FIGS. 98A-F. Exemplary SmTrip9 pep524 chemical conjugates. (A) Example of SmTrip9 pep524 with C-terminal azido-lysine modification and a N-terminal BODIPY dye. The dye is not limited to BODIPY and could be any fluorophore, BRET partner, or FRET dye/quencher partner. Dyes can be incorporated with any other combination of conjugation handles on the C-terminus. (B) Example of SmTrip9 pep524 with C-terminal azido-lysine modification for copper catalyzed or copper free 1,3-dipolar cycloaddition reactions ("Click") with unstrained or strained alkyne targets separately introduced chemically or biologically on proteins/peptides/DNA and RNA oligonucleotides/small molecules. (C) Example of SmTrip9 pep524 with C-terminal propargyl glycine modification for copper catalyzed or copper free 1,3-dipolar cycloaddition reactions ("Click") with azide, diazo, tetrazine targets separately introduced chemically or biologically on proteins/peptides/DNA and RNA oligonucleotides/small molecules. (D) Example of SmTrip9 pep524 with C-terminal cysteine modification for disulfide bond formation on solvent exposed or protected cysteine targets on proteins/peptides/DNA and RNA oligonucleotides/small molecules or proteins/peptides/DNA and RNA oligonucleotides/small molecules that have been prepared with maleimide handles or an NHS-ester. (E) Example of SmTrip9 pep524 with C-terminal N-hydroxysuccinimide ester (NHS-ester) for general conjugation to nucleophilic targets (i.e. lysines) on proteins/peptides/DNA and RNA oligonucleotides/small molecules. (F) Example of SmTrip9 pep524 with C-terminal N-hydroxysuccinimide ester (NHS-ester) for general conjugation to nucleophilic targets (i.e. lysines) on proteins/peptides/DNA and RNA oligonucleotides/small molecules.

FIG. 113. Table of the results of FRB-FKBP facilitated complementation in E. coli lysates with SmTrip9 pep435/434.

FIG. 114. Table of the results of FRB-FKBP facilitated complementation in E. coli lysates with SmTrip9 pep435/434.

FIG. 115. Table of the results of FRB-FKBP facilitated complementation in E. coli lysates with SmTrip9 pep435/434.

FIGS. 116A-C. Table of the results FRB-FKBP facilitated complementation assay screen with combinational SmTrip9 variants.

FIG. 117. Table of the results FRB-FKBP facilitated complementation assay screen with combinational SmTrip9 variants.

FIG. 118. Table of the results FRB-FKBP facilitated complementation assay screen with combinational SmTrip9 variants.

FIG. 119. Table of the results FRB-FKBP facilitated complementation assay screen with combinational SmTrip9 variants.

FIG. 120. Table of the results FRB-FKBP facilitated complementation assay screen with combinational SmTrip9 variants.

FIG. 121. Table of the results FRB-FKBP facilitated complementation assay screen with combinational SmTrip9 variants.

FIGS. 122A-B. Table of the results FRB-FKBP facilitated complementation assay screen with combinational SmTrip9 variants.

FIG. 123. Table of Kd and Bmax of SmTrip9 synthetic peptides.

FIG. 124. Table of Kd and Bmax of SmTrip9 synthetic peptides.

FIG. 125. Table of Kd and Bmax of SmTrip9 synthetic peptides.

FIG. 126. Table of Kd and Bmax of SmTrip9 synthetic peptides.

FIG. 127. Table of Kd and Bmax of SmTrip9 synthetic peptides.

FIG. 128. Table of Kd and Bmax of SmTrip9 synthetic peptides.

FIG. 129. Table of Kd and Bmax of SmTrip9 synthetic peptides.

FIG. 130. Table of Kd and Bmax of SmTrip9 synthetic peptides.

FIGS. 131A-C. Table of Solubility of synthetic SmTrip9 peptides.

Figure 132:
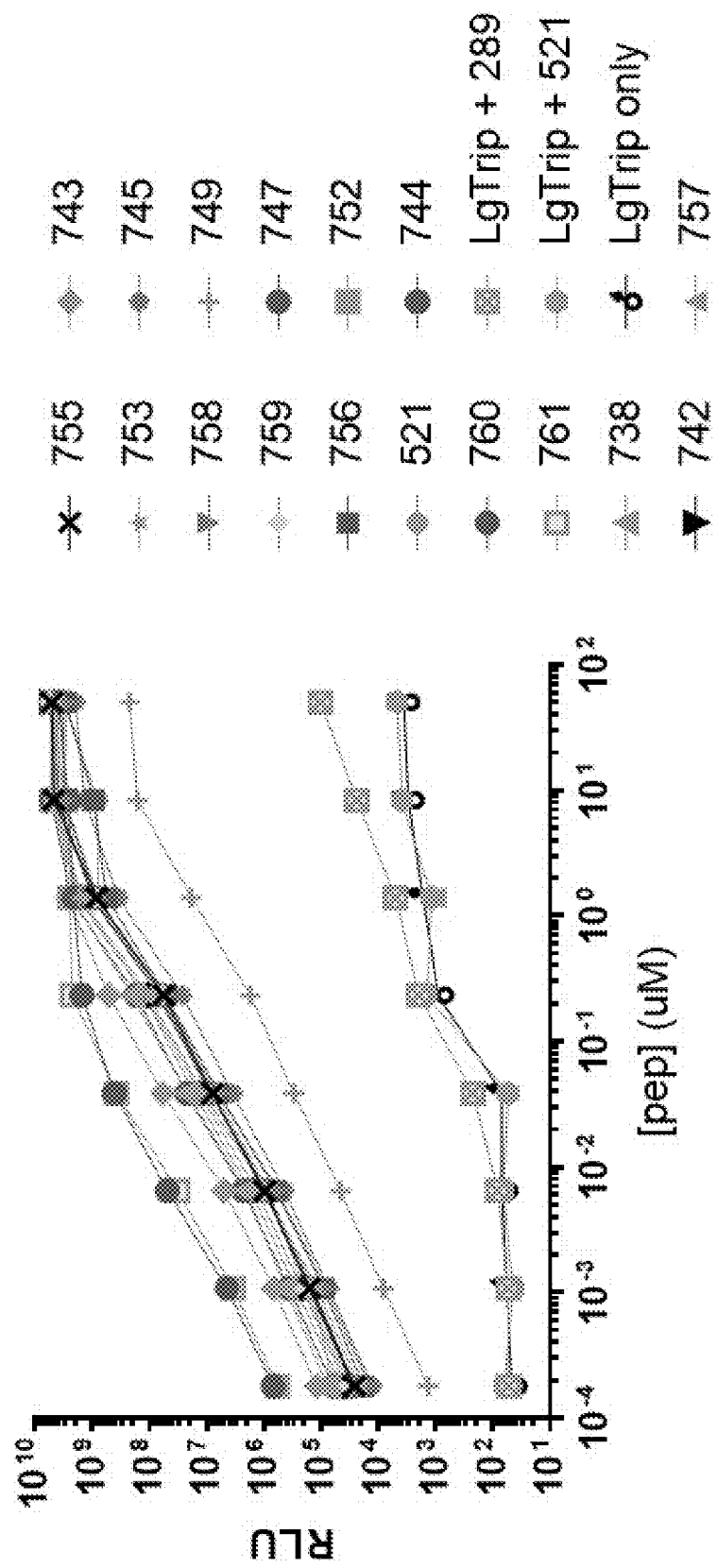

FIG. 132. Graph of biochemical co-titration of SmTrip9 synthetic peptides and pep289.

Figure 133:
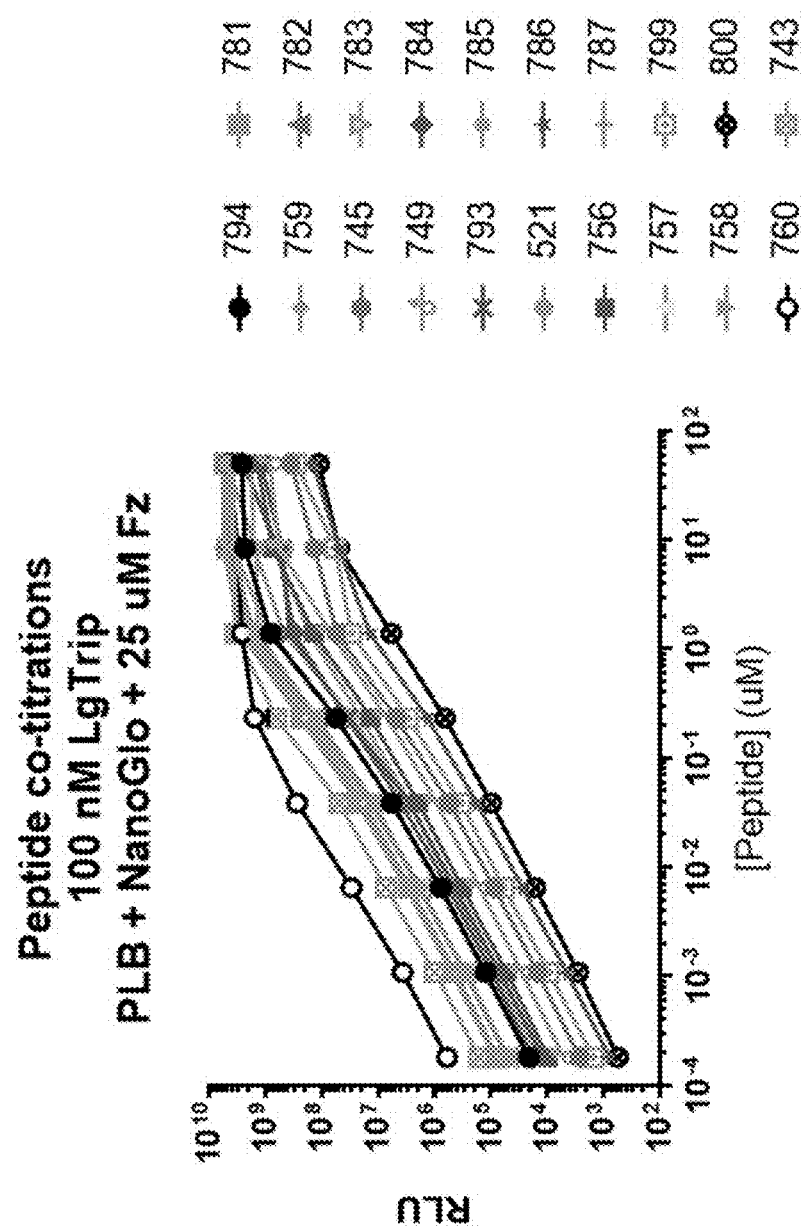

FIG. 133. Graph of biochemical co-titration of SmTrip9 synthetic peptides and pep289.

Figure 134:
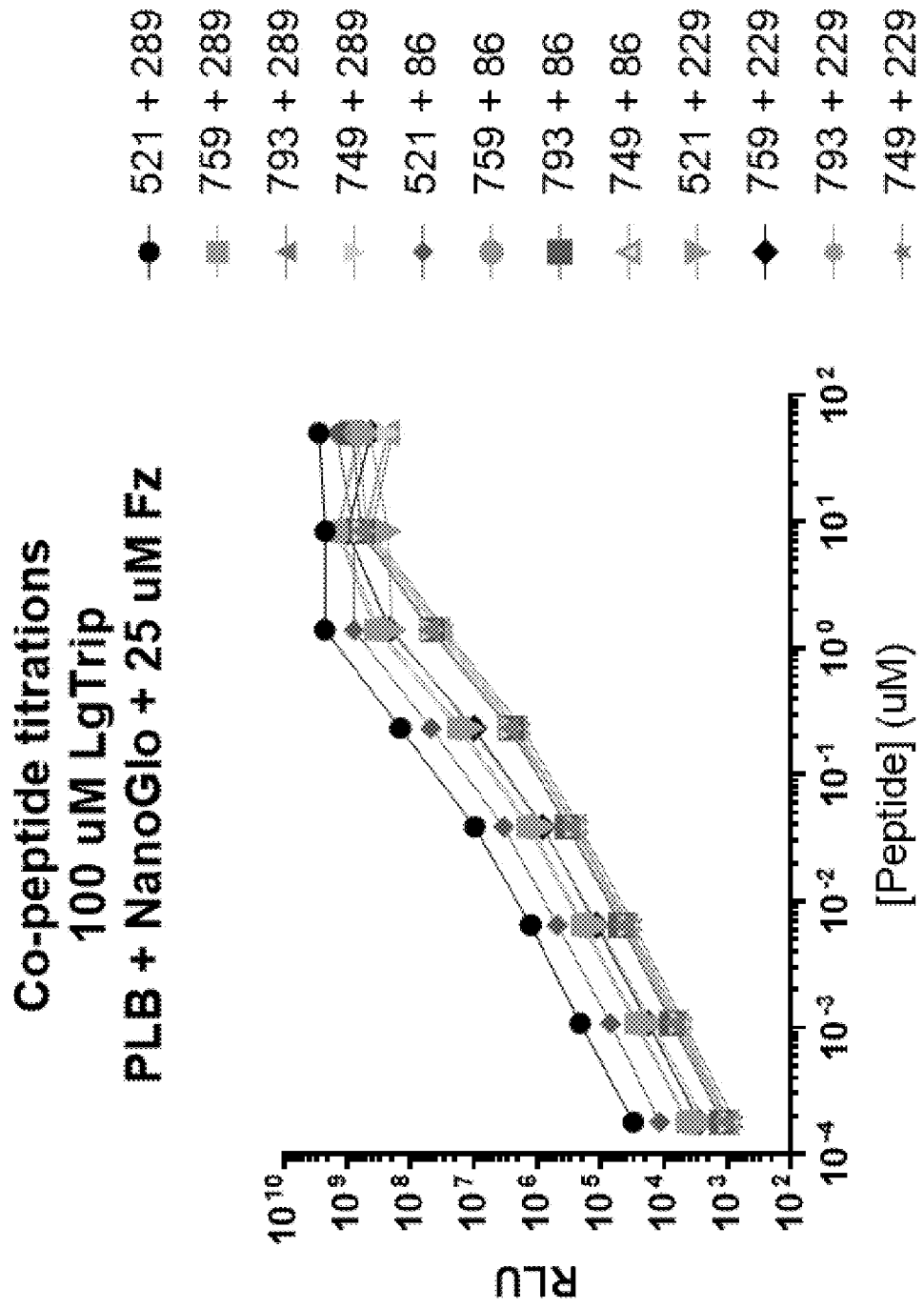

FIG. 134. Graph of biochemical co-titration of SmTrip9 and SmTrip 10 synthetic peptides.

Figure 135:
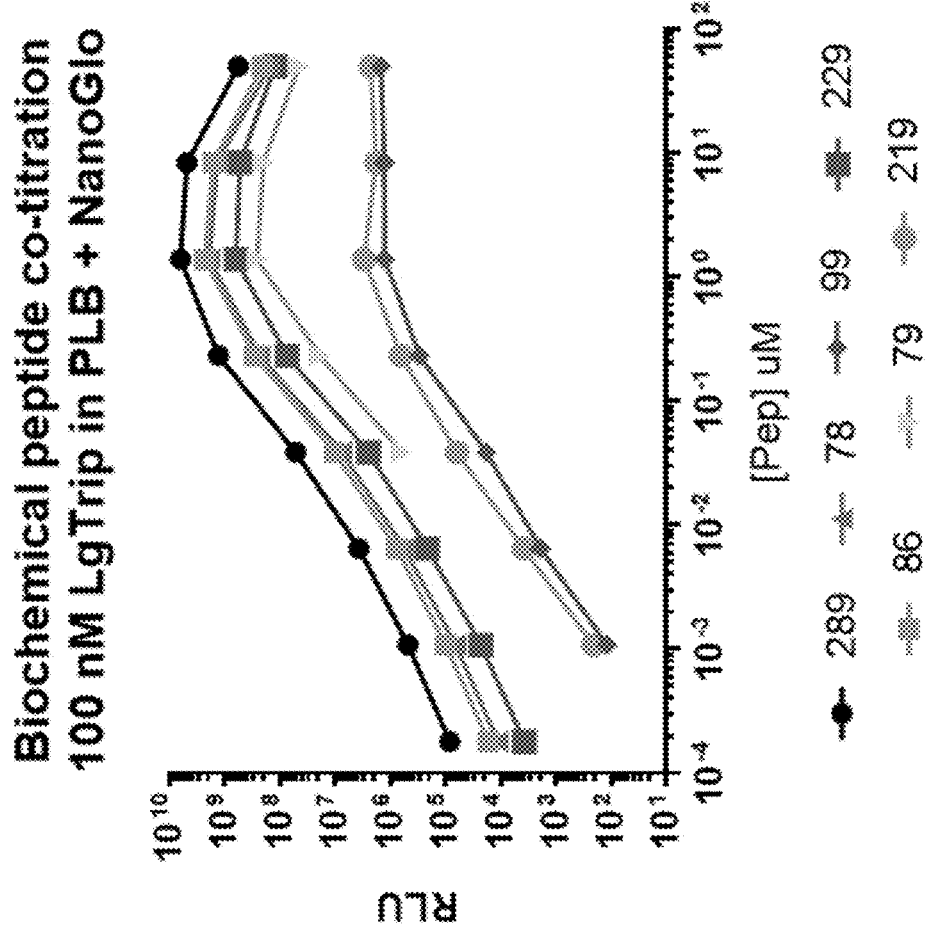

FIG. 135. Graph of biochemical co-titration of pep521 and alternative SmTrip 10 synthetic peptides.

Figure 136:
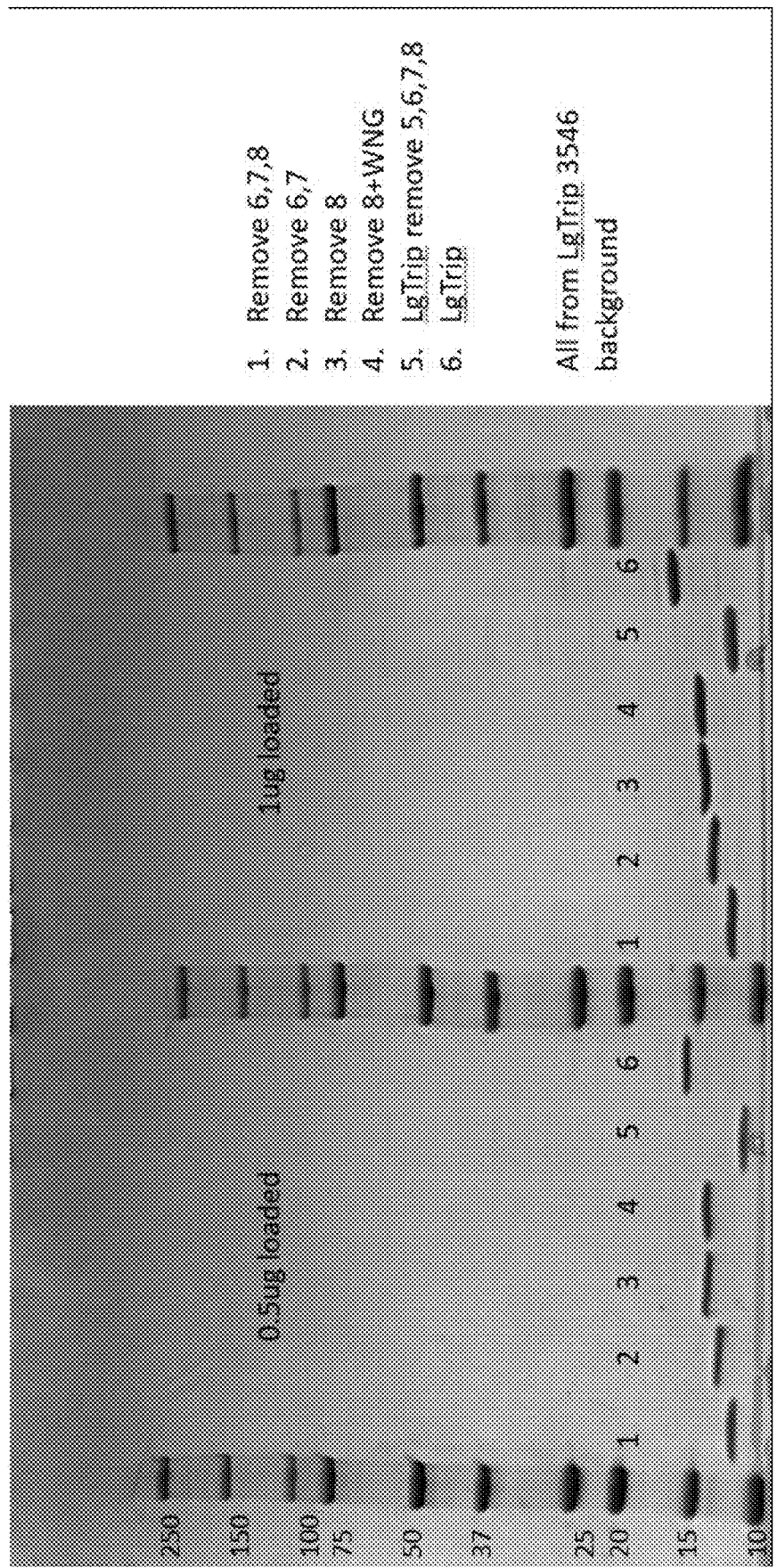
Figure 137A:
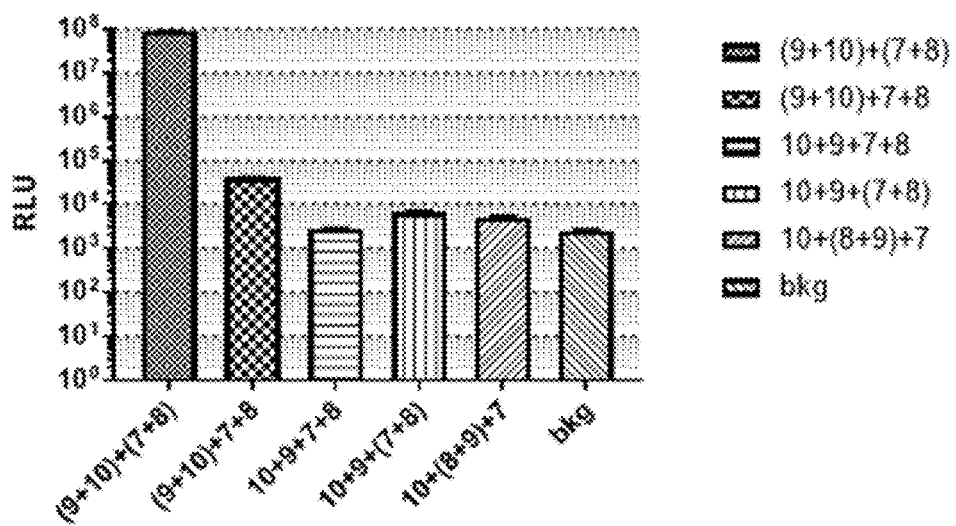
Figure 137B:
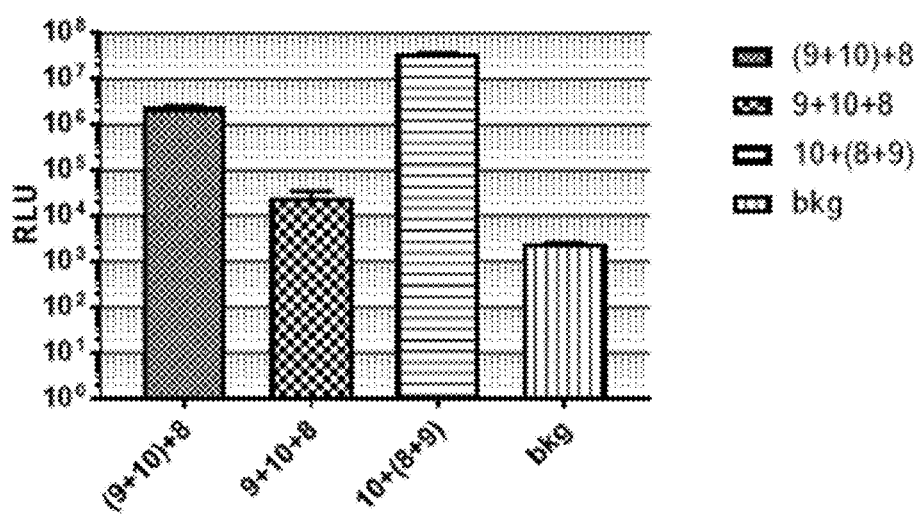
Figure 137C:
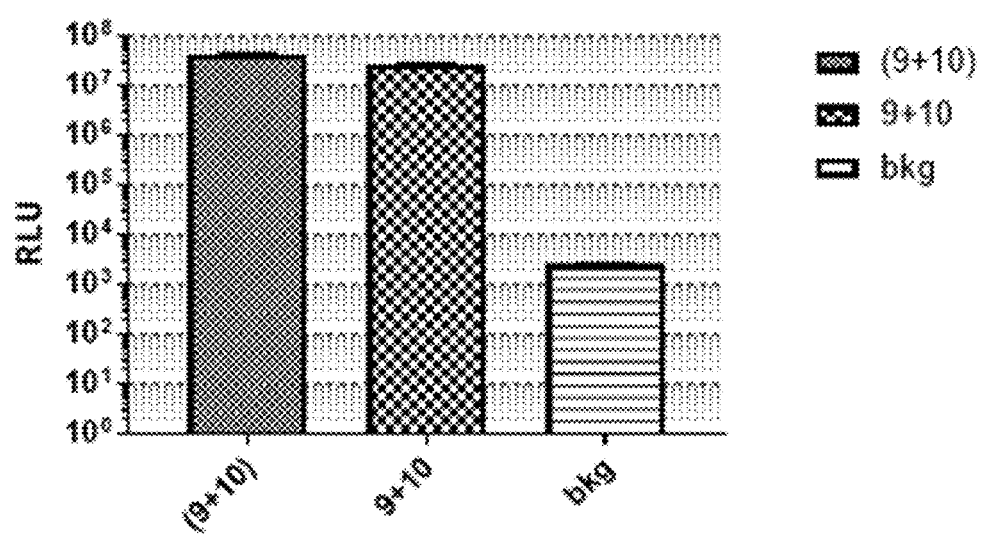
Figure 137D:
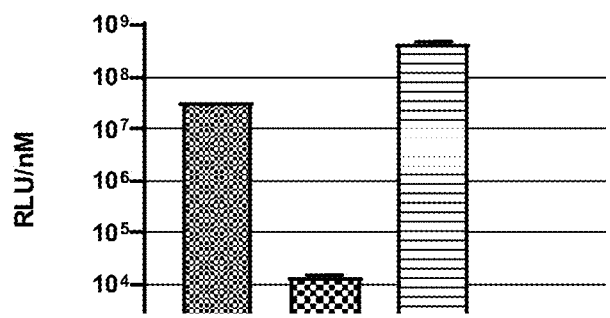

FIG. 136. SDS PAGE gel of strand removal (purification) from LgTrip 3546 template.

FIGS. 137A-D. Graphs of strand removal proteins with various combinations of peptides.

Figure 138A:
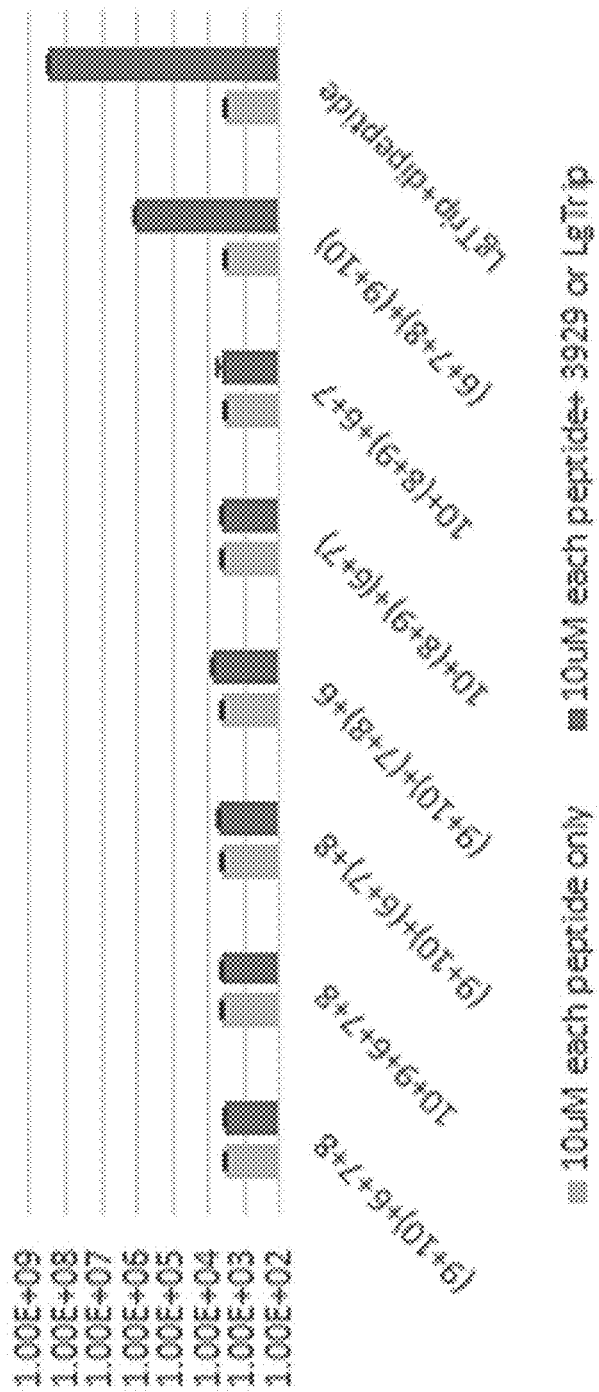
Figure 138B:
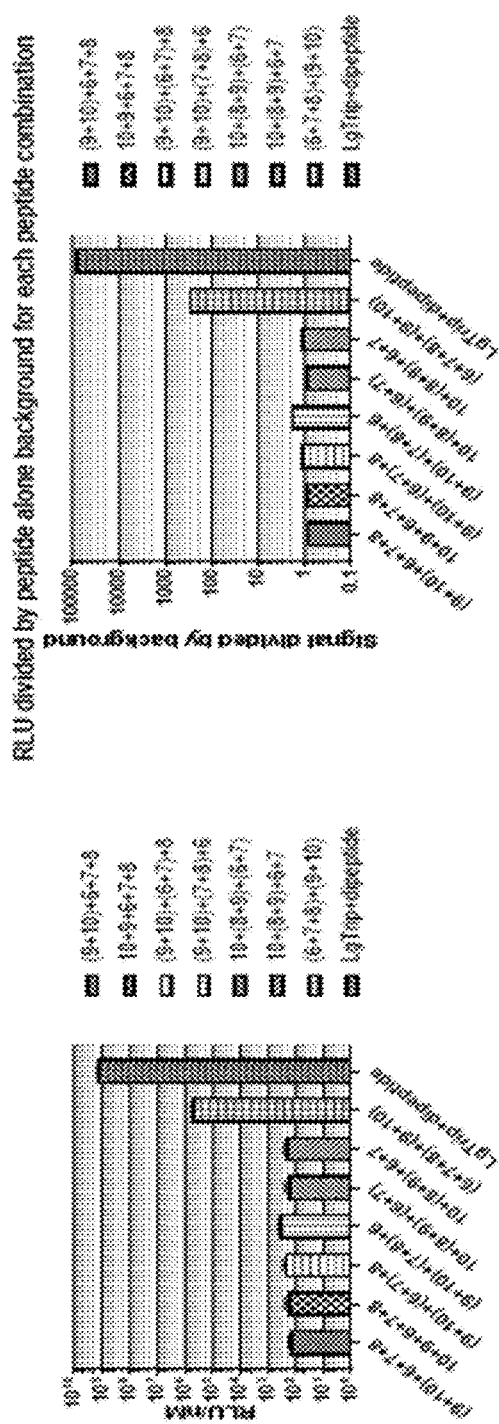

FIGS. 138A-B. graphs of strands 6, 7, 8, 9, or 10 removal (purification) from LgTrip 3546 template.

FIGS. 139A-E. Graphs of Kd and Bmax values of the dipeptide titrations.

Figure 140:
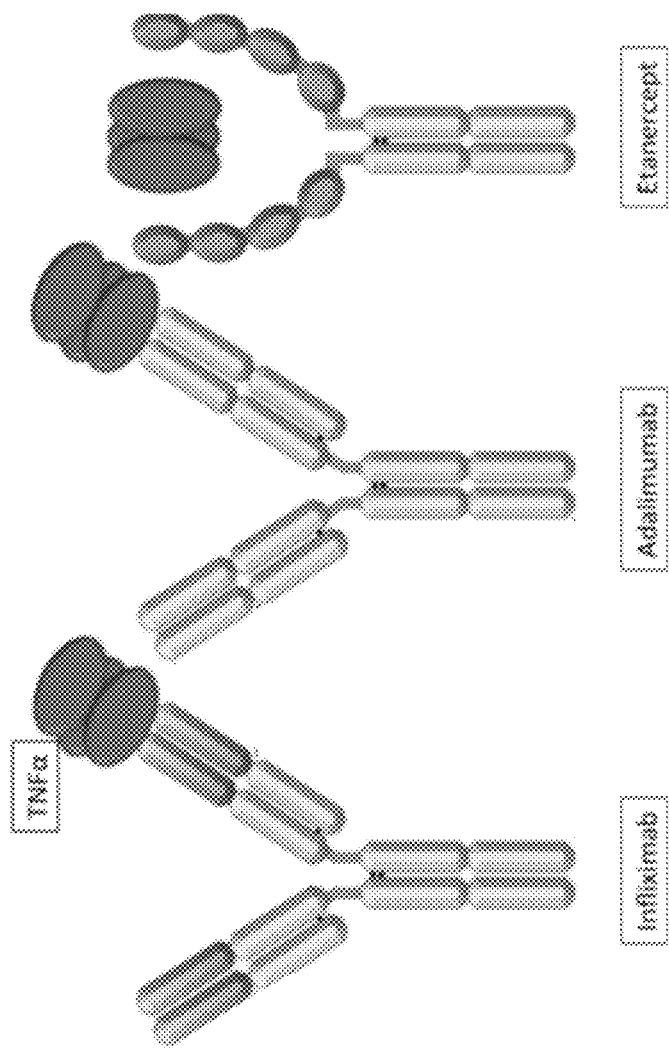

FIG. 140. Schematic depicting the approach taken to develop a solution-based homogeneous, quantitative assay for anti-TNFa biologic agents Remicade, Humira, and Enbrel using tripartite protein G and TNFa fusion proteins.

Figure 141:
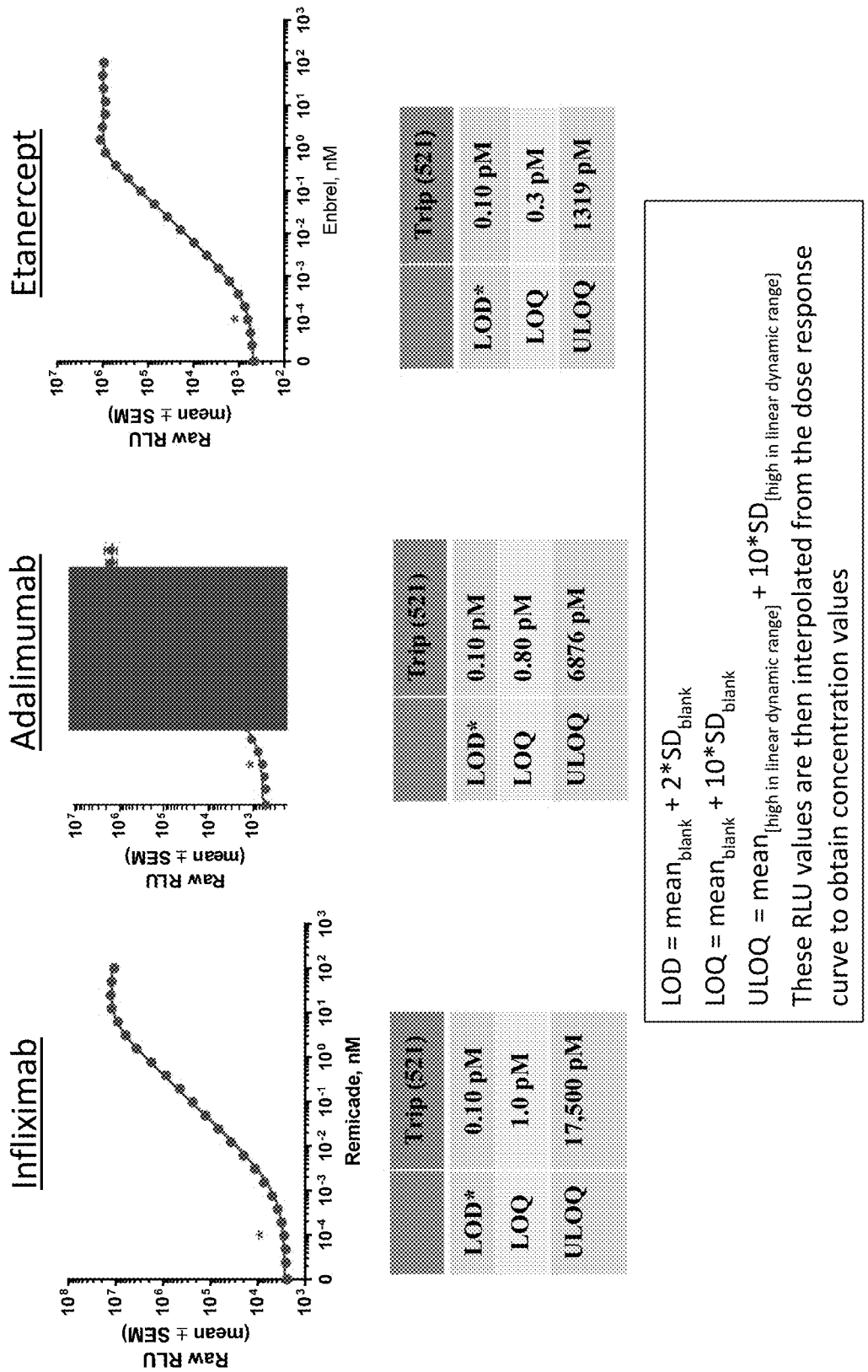

FIG. 141. Graphs depicting quantitative analysis of TNFa inhibitor dose responses via facilitated complementation with SmTrip9 pep521-protein G (SEQ ID NO: 268) and TNFa-SmTrip10 pep289 (VS-HiBiT; SEQ ID NO: 150) fusion proteins with purified LgTrip 3546 (SEQ ID NO: 51) in a solution-based homogeneous assay.

Figure 142:
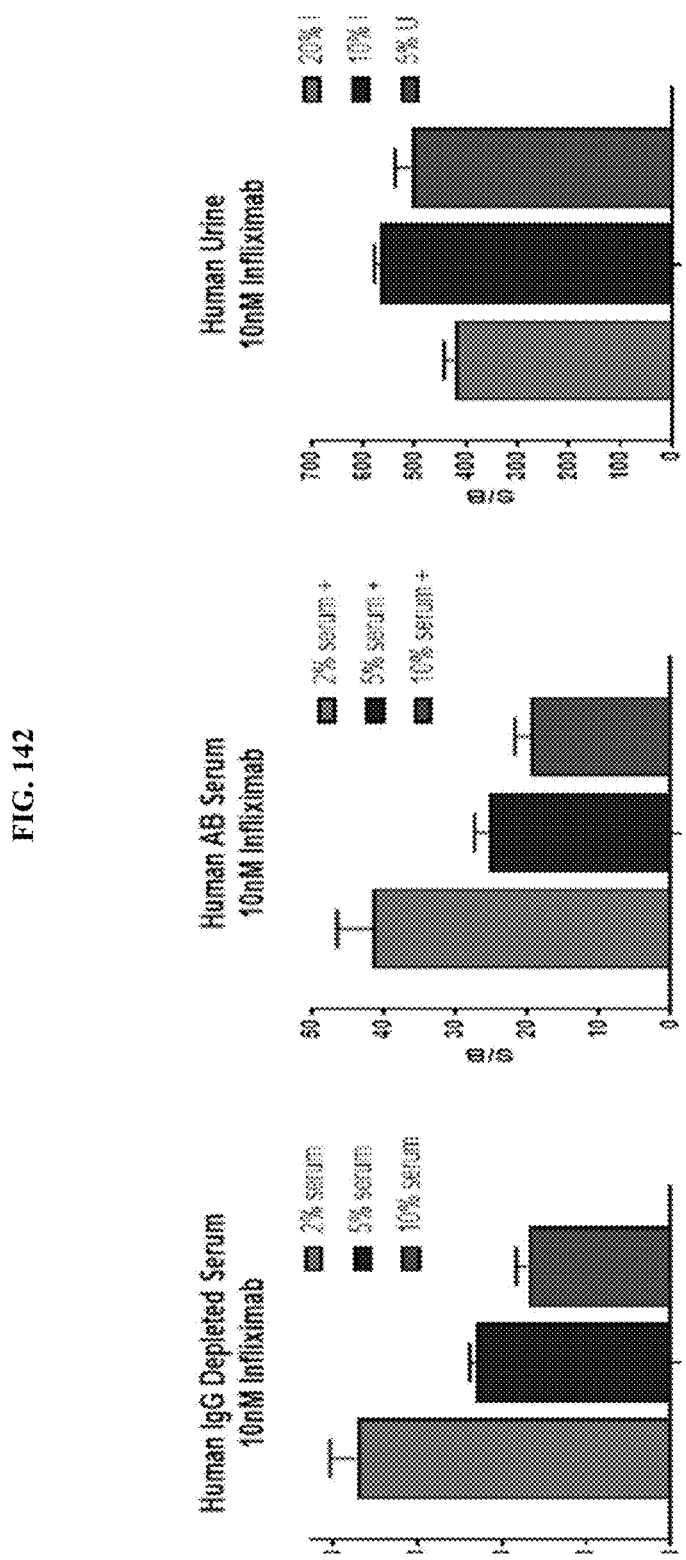

FIG. 142. Graphs depicting quantitative analysis of 10 nM infliximab via facilitated complementation with SmTrip9 pep521-protein G (SEQ ID NO: 268) and TNFa-SmTrip10 pep289 (VS-HiBiT; SEQ ID NO:150) fusion proteins with purified LgTrip 3546 (SEQ ID NO: 51) in the presence of complex sample matrices including human serum and urine using a solution-based homogenous assay.

Figure 143:
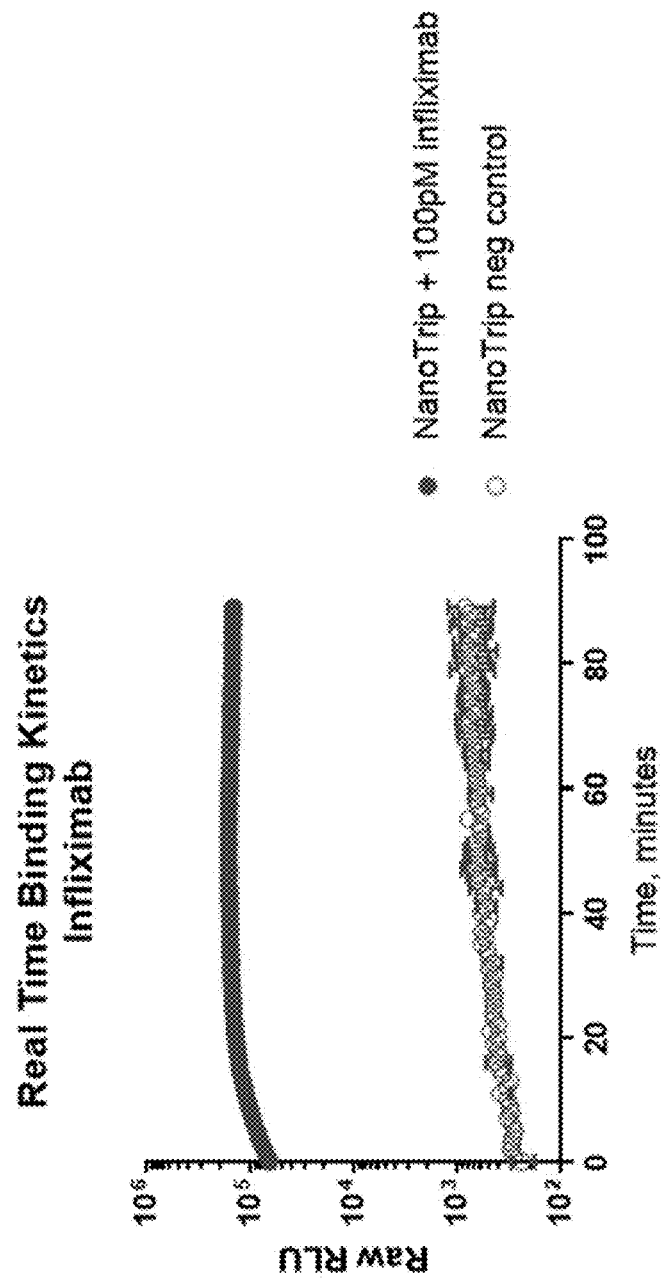

FIG. 143. Graph depicting the binding kinetics of signal generation measuring 100 pM of infliximab via facilitated complementation with SmTrip9 pep521-protein G (SEQ ID NO: 268) and TNFa-SmTrip10 pep289 (VS-HiBiT; SEQ ID NO:150) fusion proteins with purified LgTrip 3546 (SEQ ID NO: 51) in a solution-based homogeneous assay.

Figure 144:
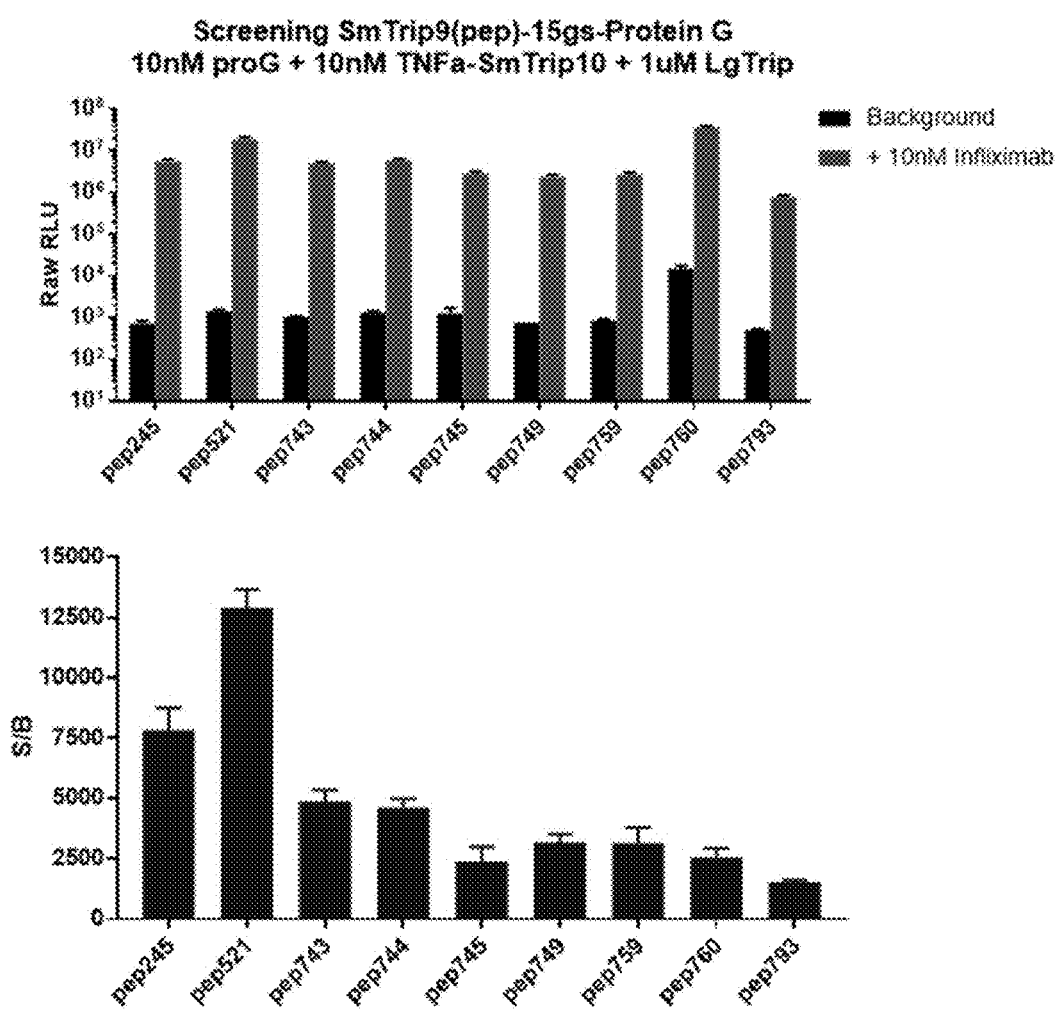

FIG. 144. Graph depicting signal generation measuring 10 nM of infliximab via facilitated complementation of different SmTrip9 pep(X)-protein G variants and TNFa-SmTrip10 pep289 (VS-HiBiT; SEQ ID NO:150) fusion proteins with purified LgTrip 3546 (SEQ ID NO: 51) in a solution-based homogenous assay.

Figure 145:
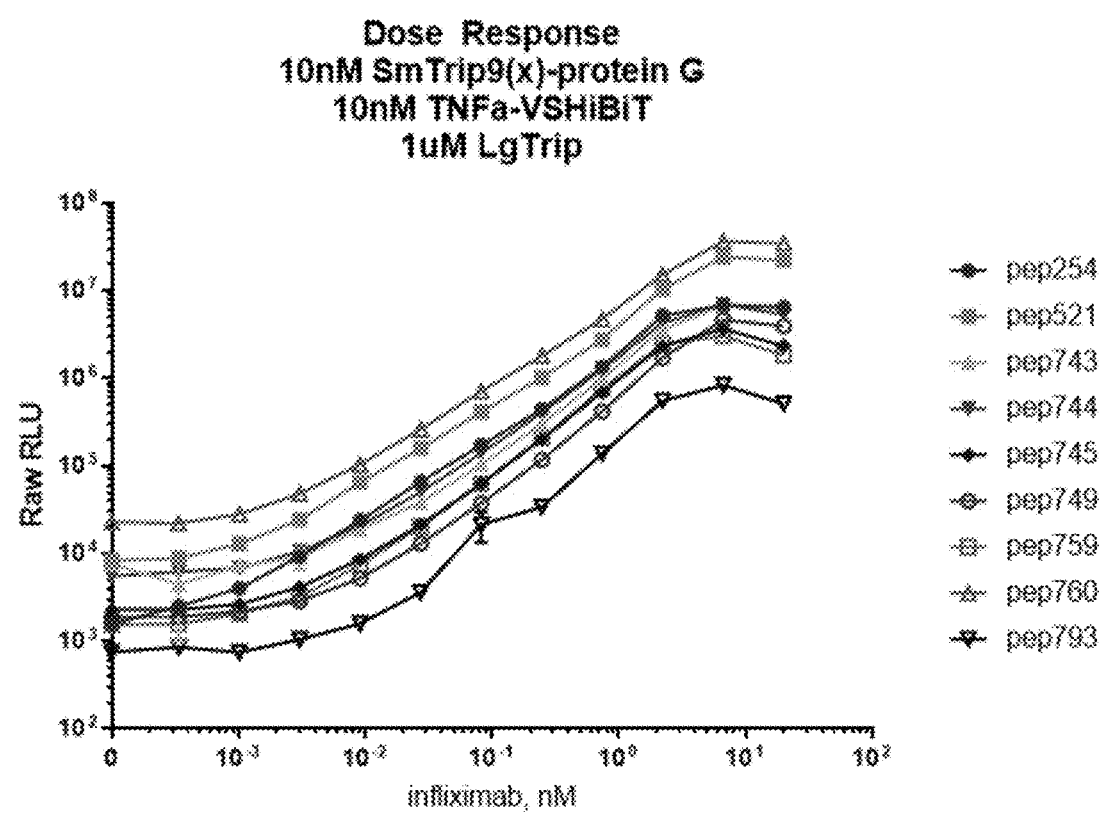

FIG. 145. Schematic depicting the approach taken to develop a homogenous cell-based, quantitative assay for anti-EGFR biologic agents panitumumab and cetuximab using SmTrip9-protein G fusion proteins and HEK293 cells expressing SmTrip10 pep289-EGFR (SEQ ID NO:150).

Figure 146:
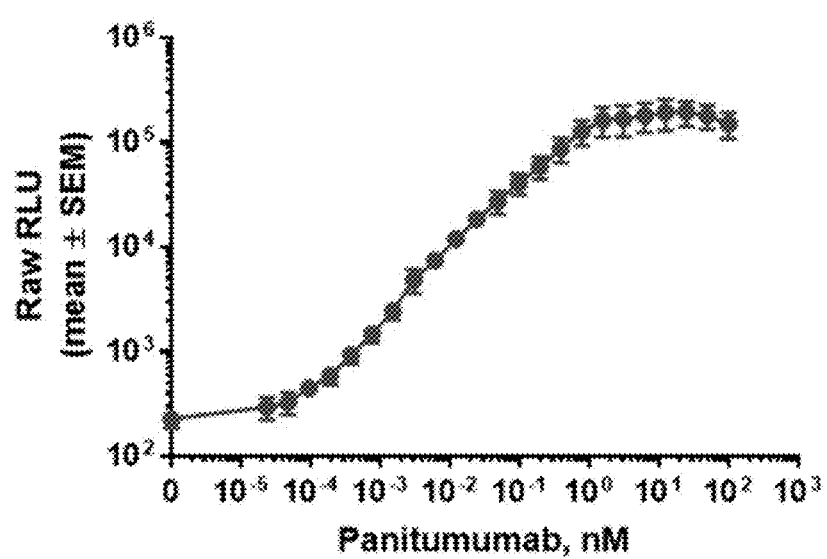

FIG. 146. Graph depicting quantitation of Panitumumab via facilitated complementation with SmTrip9 pep521-protein G (SEQ ID NO: 268) fusion protein and SmTrip10 pep289-EGFR (VS-HiBiT; SEQ ID NO:150) expressing cells with purified LgTrip 3546 (SEQ ID NO: 51) in a cell-based homogeneous assay.

Figure 147:
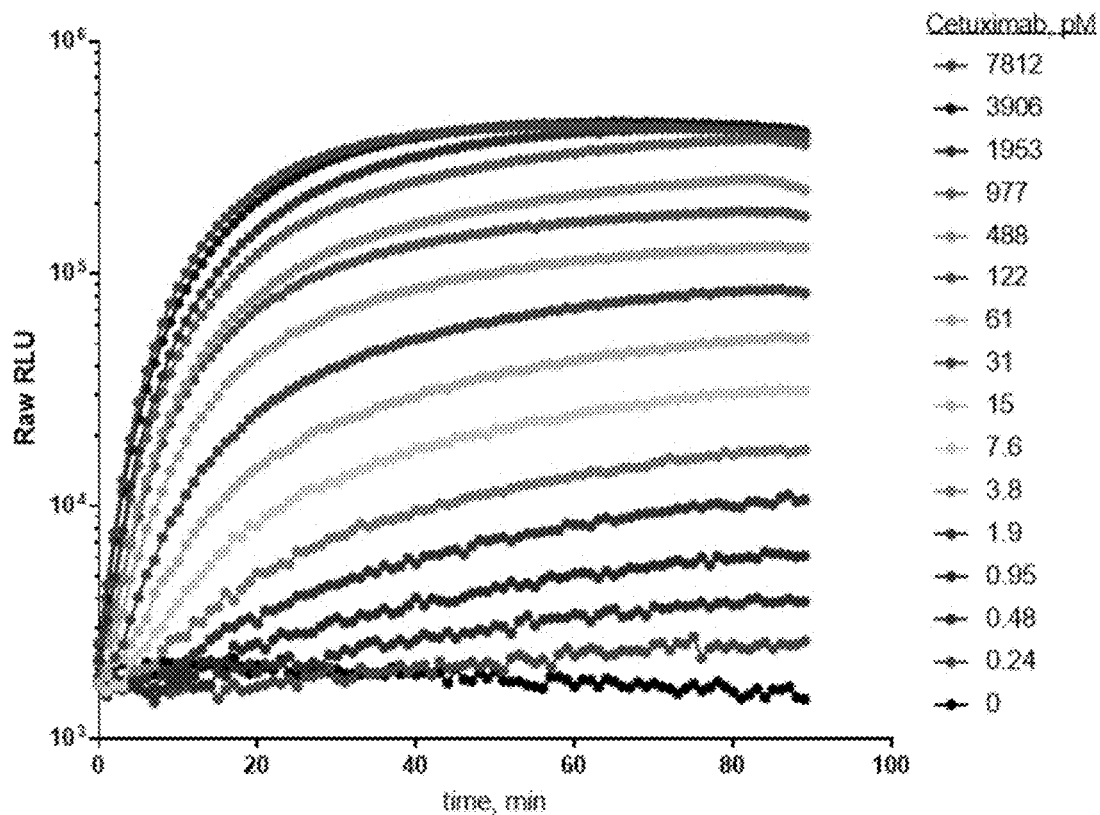

FIG. 147. Graph depicting the real time binding kinetics of signal generation measuring Cetuximab via facilitated complementation with SmTrip9 pep521-protein G (SEQ ID NO: 268) fusion protein and SmTrip10 pep289-EGFR (VS-HiBiT; SEQ ID NO:150) expressing cells with purified LgTrip 3546 (SEQ ID NO: 51) in a cell-based homogeneous assay.

Figure 148:
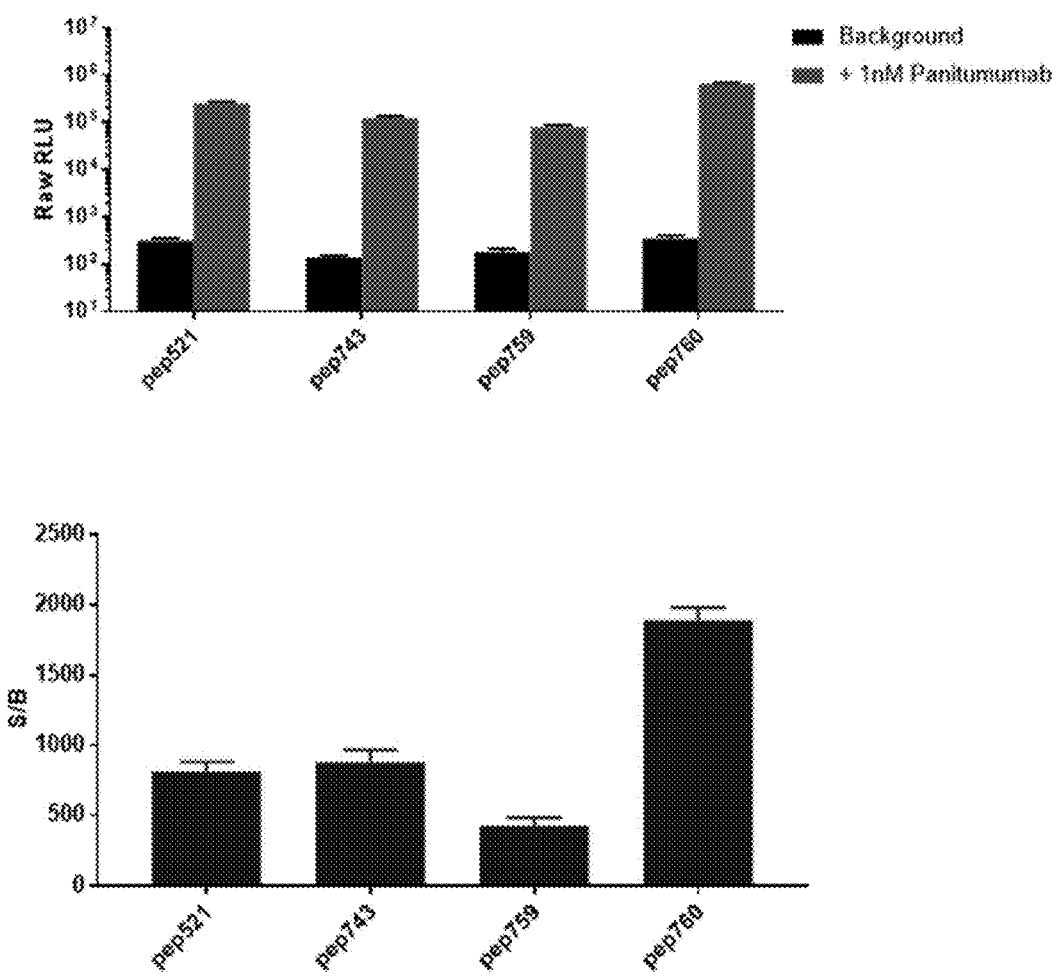

FIG. 148. Graph depicting signal generation measuring 1 nM of panitumumab via facilitated complementation of different SmTrip9 pep(X)-protein G variants and SmTrip10 pep289-EGFR (VS-HiBiT; SEQ ID NO:150) expressing cells paired with purified LgTrip 3546 (SEQ ID NO: 51) in a cell-based homogenous assay.

Figure 149:
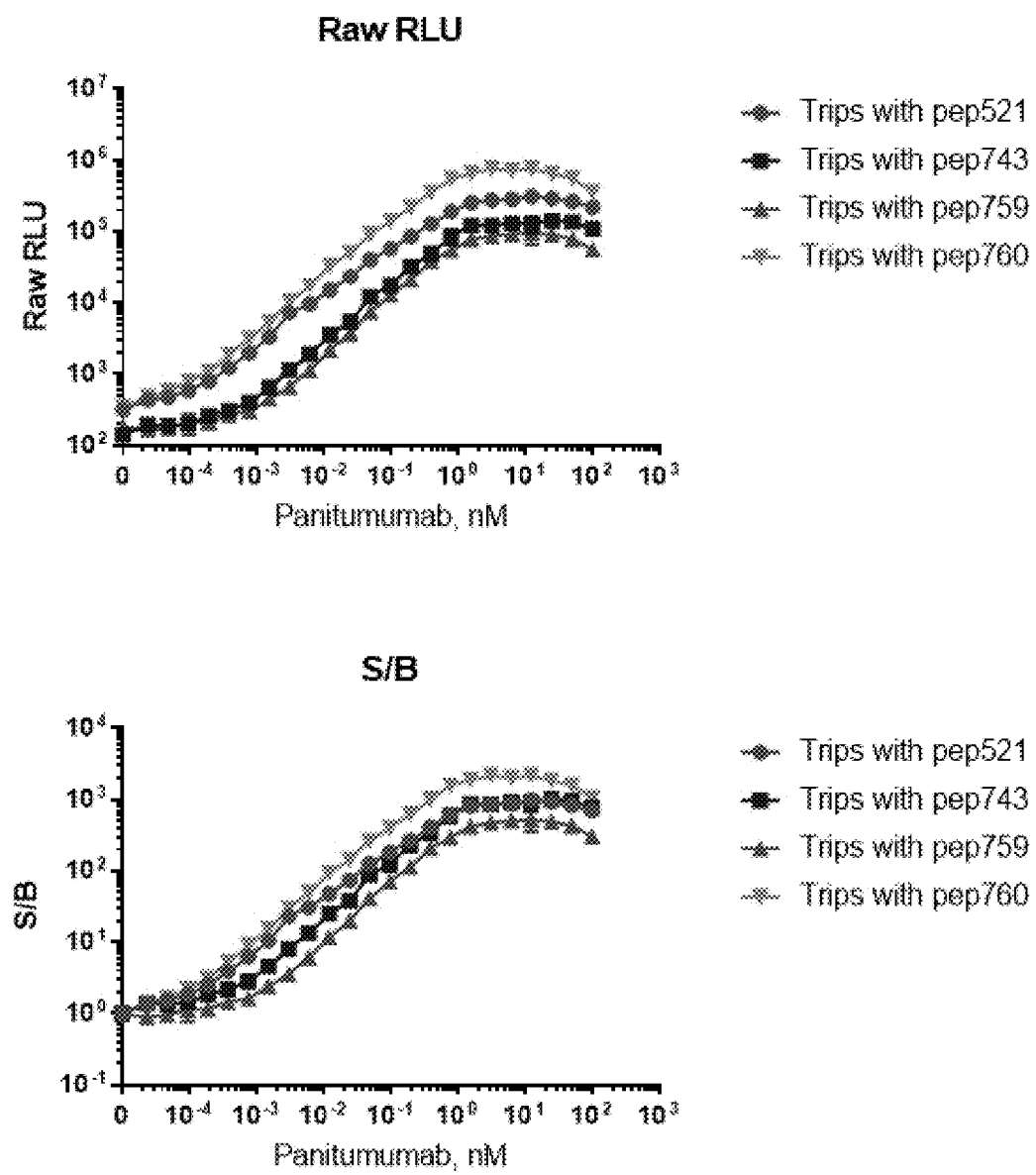

FIG. 149. Graph depicting quantitation of panitumumab dose response via facilitated complementation of different SmTrip9 pep(X)-protein G variants and SmTrip10 pep289-EGFR (VS-HiBiT; SEQ ID NO:150) expressing cells paired with purified LgTrip 3546 (SEQ ID NO: 51) in a cell-based homogenous assay.

Figure 150:
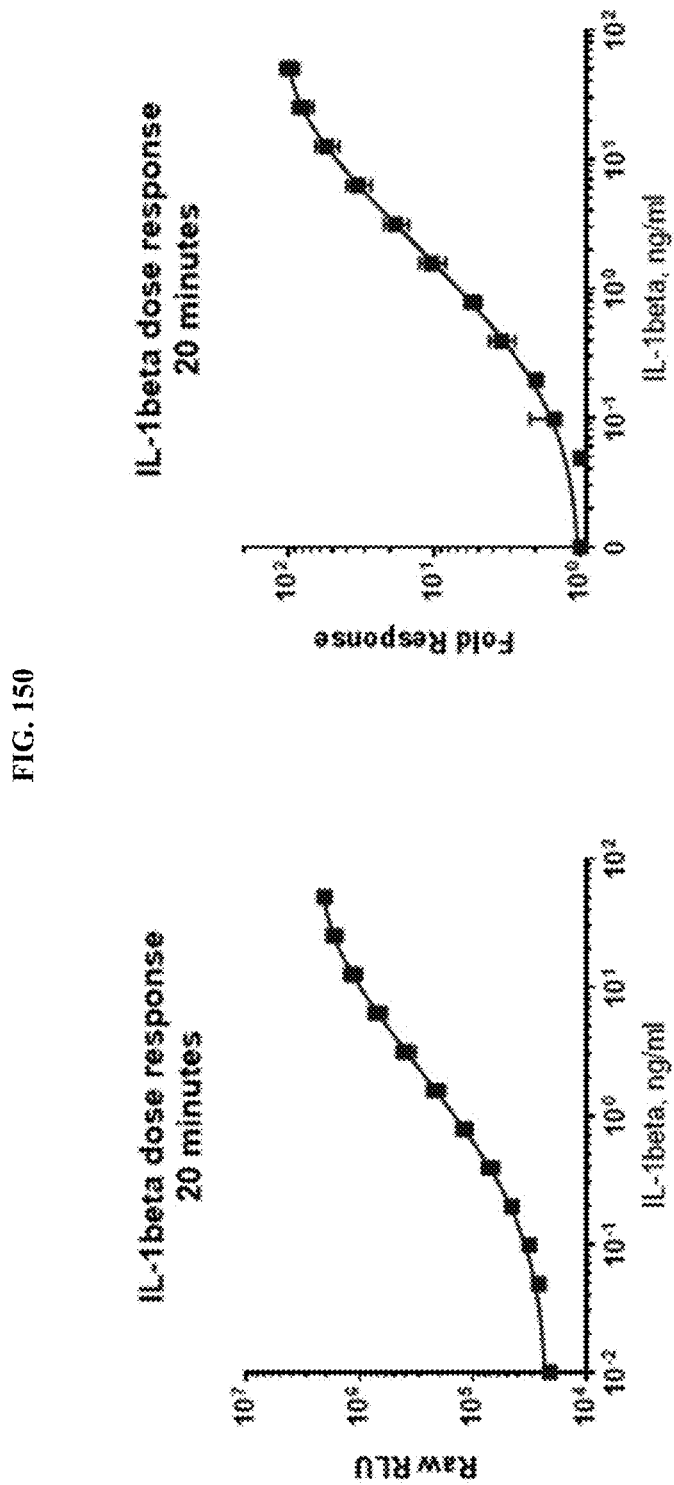

FIG. 150. Graphs depicting quantitation of human IL-1beta using Halotag®-SmTrip9 pep521 (SEQ ID NO: 268) and HaloTag®-SmTrip10 pep289 (SEQ ID NO: 150) chemically-labeled paired antibodies in a solution-based homogeneous assay. Real-time binding kinetics for human Troponin using NanoTrip™ chemically labeled paired antibodies.

Figure 151:
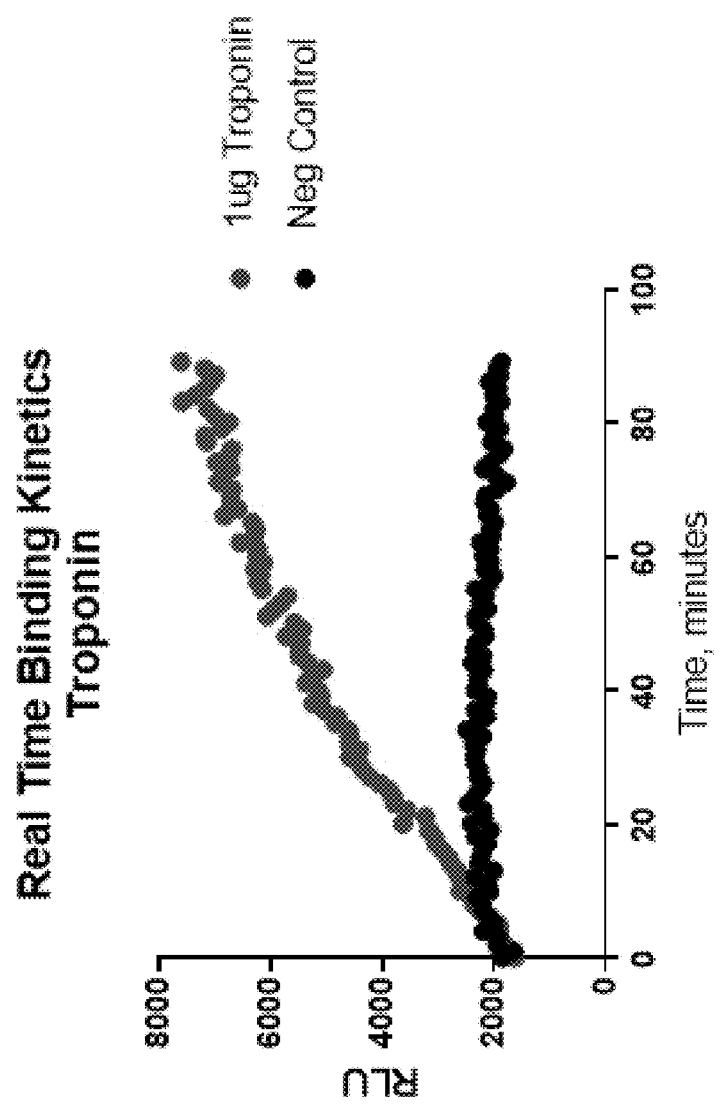

FIG. 151. Graphs depicting real time binding kinetics for quantitation of human Troponin using Halotag®-SmTrip9 pep521 (SEQ ID NO: 268) and HaloTag®-SmTrip10 pep289 (SEQ ID NO: 150) chemically labeled paired antibodies in a solution-based homogeneous assay.

Figure 152:
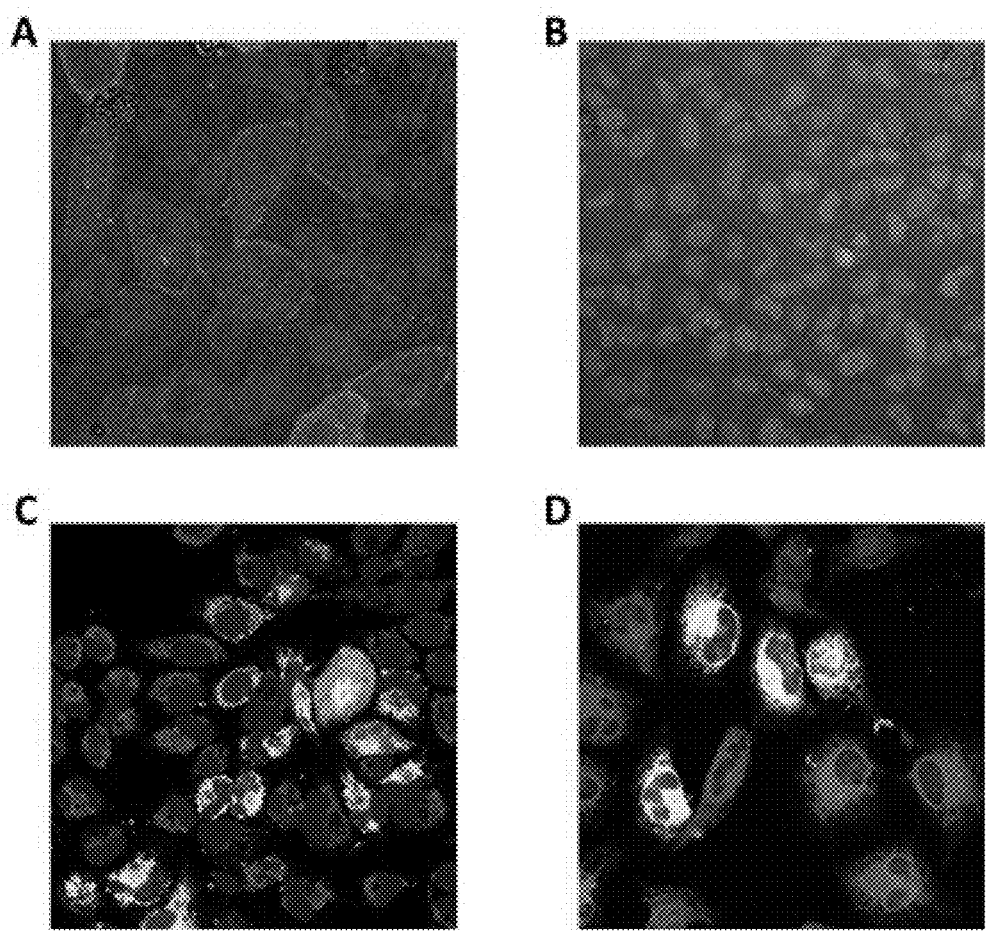

FIG. 152. Specialized peptides responsible to direct proteins to specific cellular compartments were fused to LgBiT-HaloTag®. (A) LgBiT-membrane sensor: LgBiT is in green and nucleus is in blue. (B) LgBiT-nuclear sensor: LgBiT is in green and nucleus is in blue. (C) LgBiT-mitochondria sensor: LgBiT is in green, MitoTracker is in red, and nucleus is in blue. (D) LgBiT-ER sensor: LgBiT is in green, ER marker is in red, and nucleus is in blue.

Figure 153:
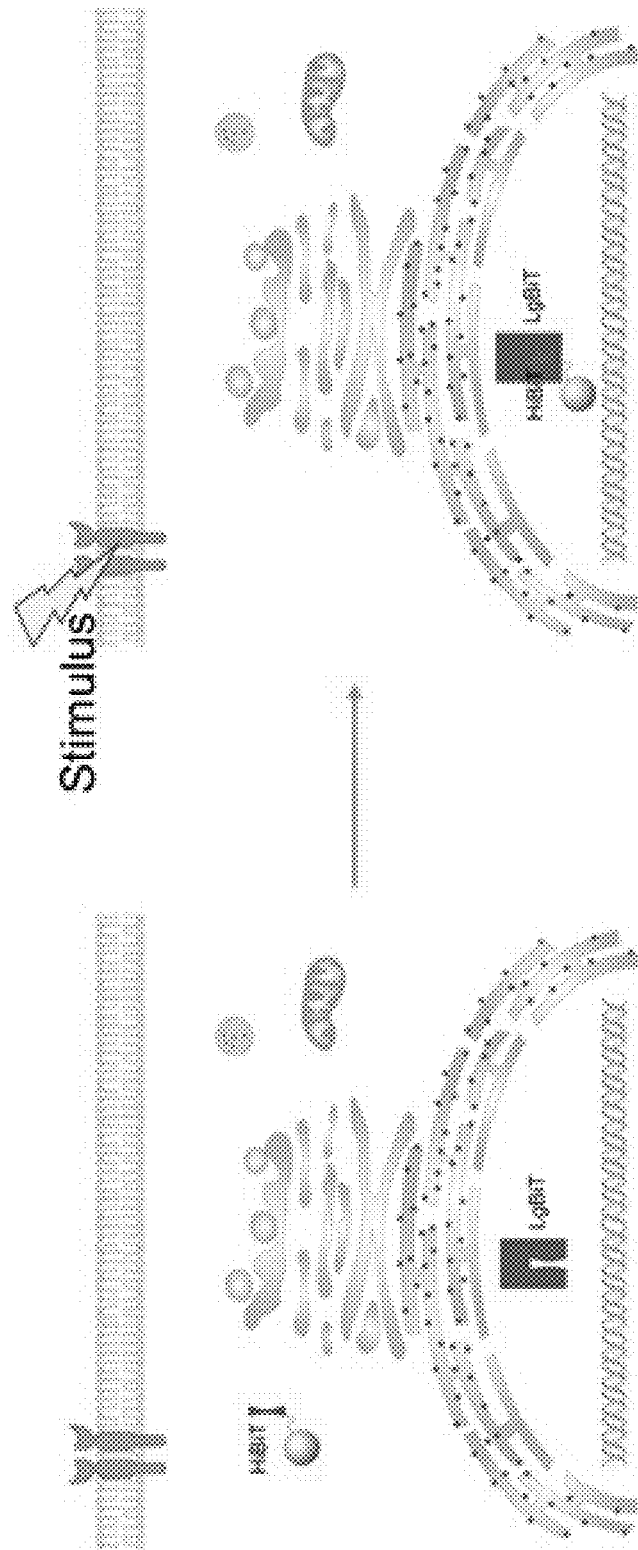

FIG. 153. Translocation assay. POI is endogenously tagged with HiBiT. Upon stimulation, the POI translocates to a different cellular compartment, for example the nucleus. A LgBiT-nuclear sensor could be used to detect this translocation event as the HiBiT meets LgBiT resulting in luminescence signal.

Figure 154:
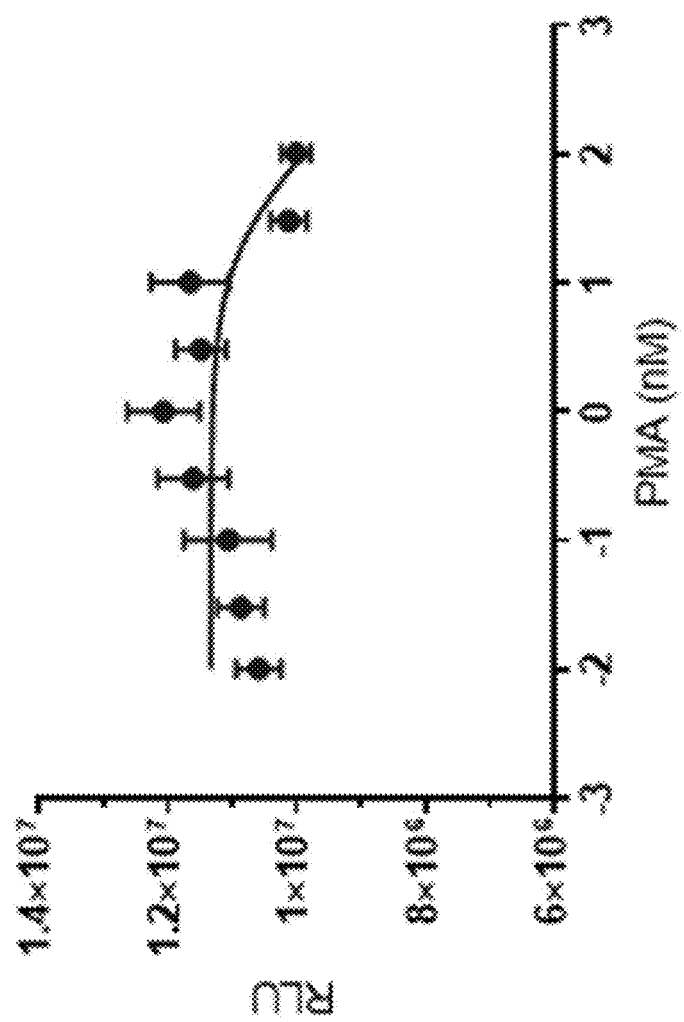

FIG. 154. Membrane translocation assay with wild-type LgBiT sensor. PKCα-HiBiT cell line was transfected with wild-type LgBiT-membrane sensor. Due to the strong interaction between LgBiT and HiBiT, the spontaneous complementation occurs, leading to no response to PMA stimuli.

Figure 155:
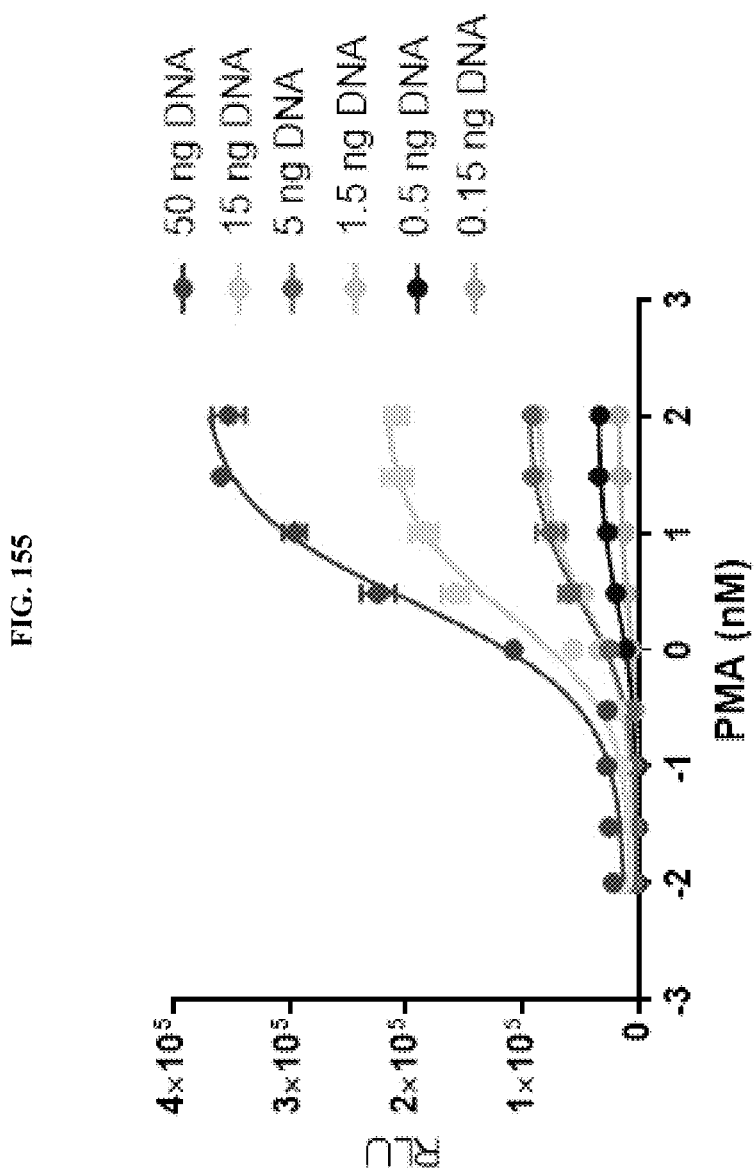

FIG. 155. Membrane translocation assay with LgBiT® sensor (SEQ ID NO: 979). PKCα-HiBiT cell line was transfected with different amount of DNA encoding LgBiT® membrane sensor. Upon PMA treatment, PKCα-HiBiT migrates to the plasma membrane, where the LgBiT® membrane sensor anchors. The assembly between HiBiT and LgBiT® produces luminescence signal, and the signal is proportional to the amount of PKCα-HiBiT on the membrane. The assay is sensitive and robust. Titration of PMA yielded similar $EC_{50}$ ($EC_{50}$=2.0 nM) regardless of the amount of sensor input. Fold response is varied between 12- to 19-fold depending on the amount of sensor input.

Figure 156:
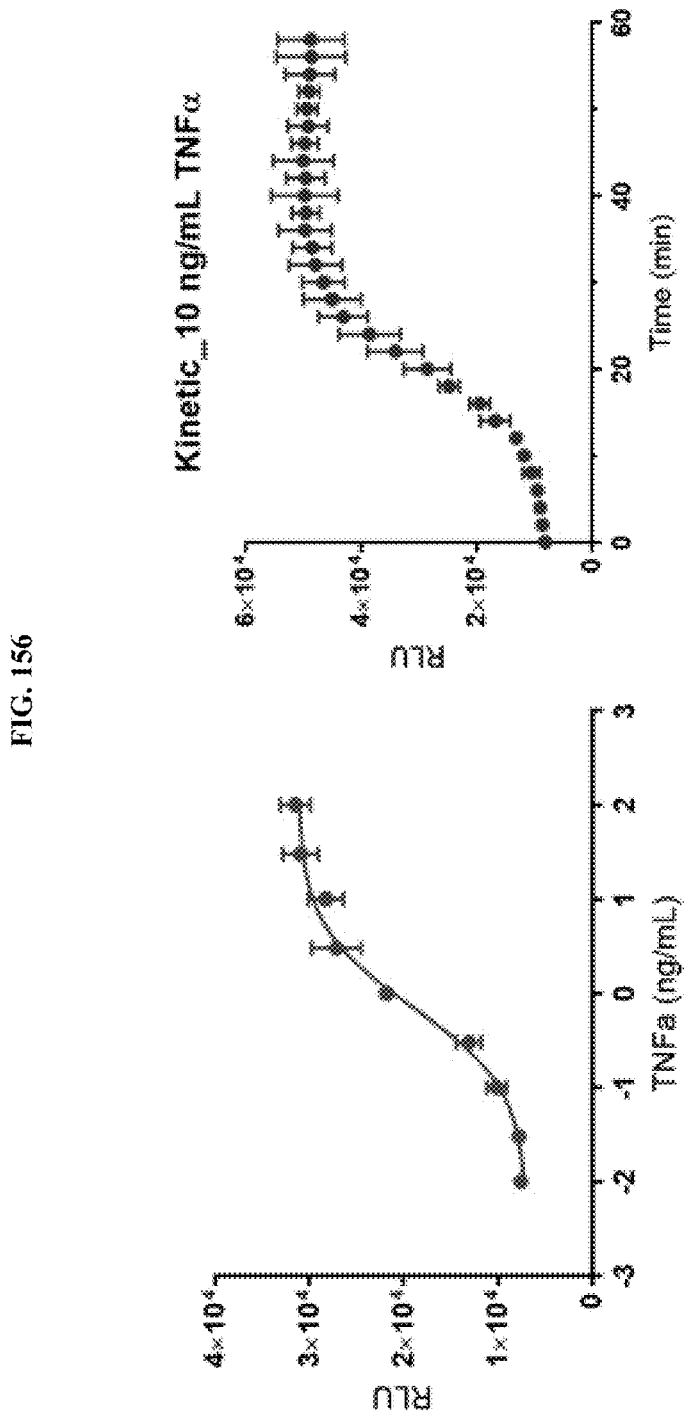

FIG. 156. Nuclear translocation assay with LgBiT® sensor. p65-HiBiT cell line was transfected with DNA encoding LgBiT® nuclear sensor. Addition of TNFα recruits p65 to the nucleus where LgBiT® nuclear sensor localizes. Complementation occurs between HiBiT and LgBiT® to produce light. The signal intensity reflects the concentration of p65 in the nucleus. Titration of TNFα yielded $EC_{50}$ of 0.7 ng/mL with fold-response of 4. Real-time measurement showed that it requires 30 min to reach the maximum accumulation of p65 in the nucleus upon stimulation.

Figure 157A:
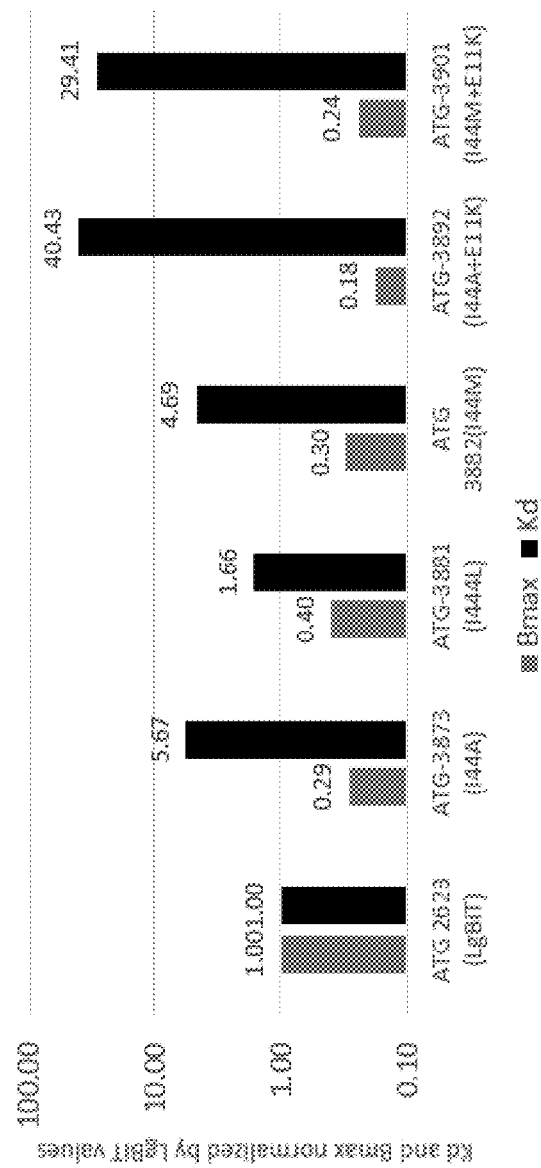

FIG. 157A-B. (A) Graph and (B) table depicting affinity and Bmax of LgBiT mutants with HiBiT.

Figure 158:
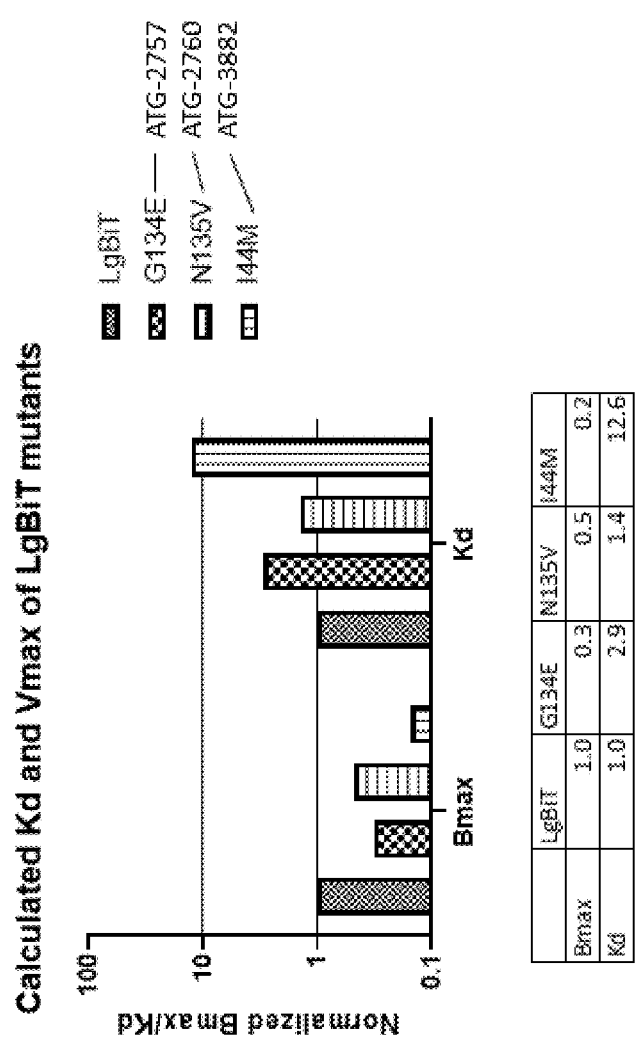

FIG. 158. Graph depicting affinity of LgBiT mutant lysates for HiBiT.

Figure 159:
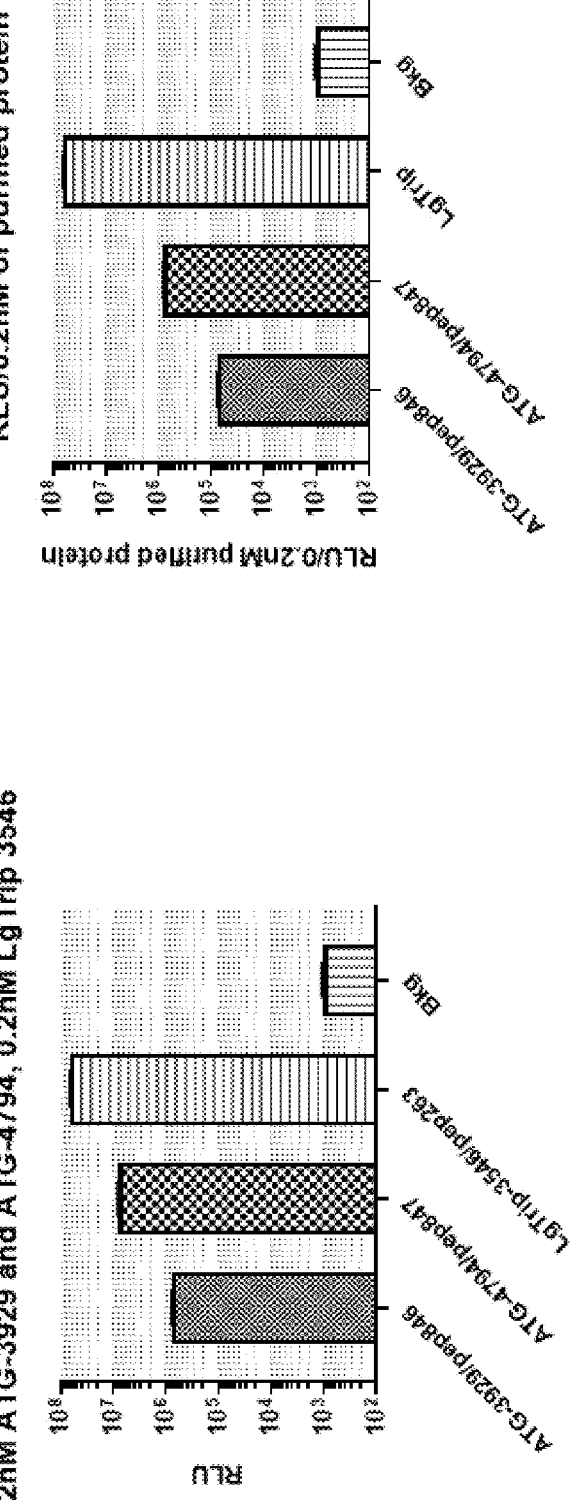

FIG. 159. Graph and table depicting the relative bioluminescence, produced in the presence of substrate, of various combinations of truncated luciferase polypeptide and peptide components.

Figure 160:
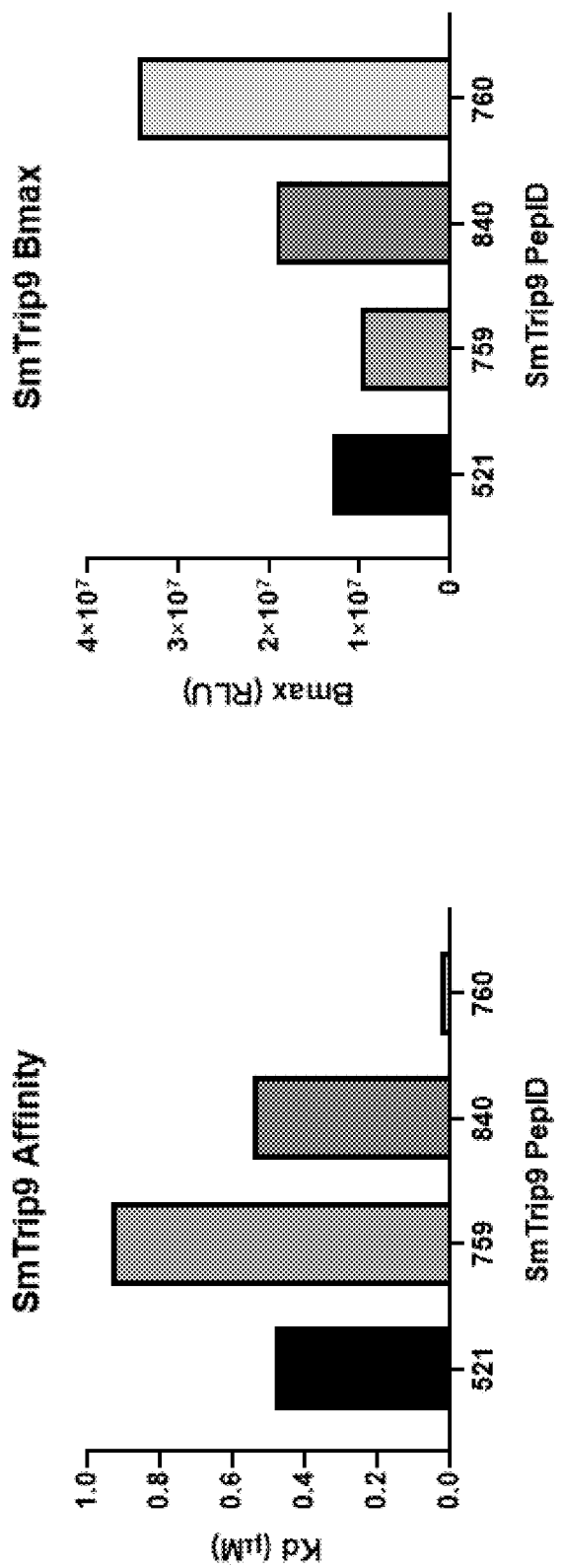

FIG. 160. LgTrip was diluted to 0.2 nM in TBS+0.01% BSA+0.01% Tergitol and pep289 was added to 25 uM. This solution was used as the diluent for 5-fold serial dilution series of SmTrip9 peptides. Samples were equilibrated 10 min at room temperature and aliquoted into assay plates in triplicate. TBS+0.01% BSA+0.01% Tergitol containing 20 uM furimazine was added to samples in 1:1 vol:vol ratio. Plates were incubated 10 min, and luminescence was read. To determine VS-HiBiT Kd, the same protocol was followed, but with saturating SmTrip9 (20× Kd) and titration of VS-HiBiT.

Figure 161:
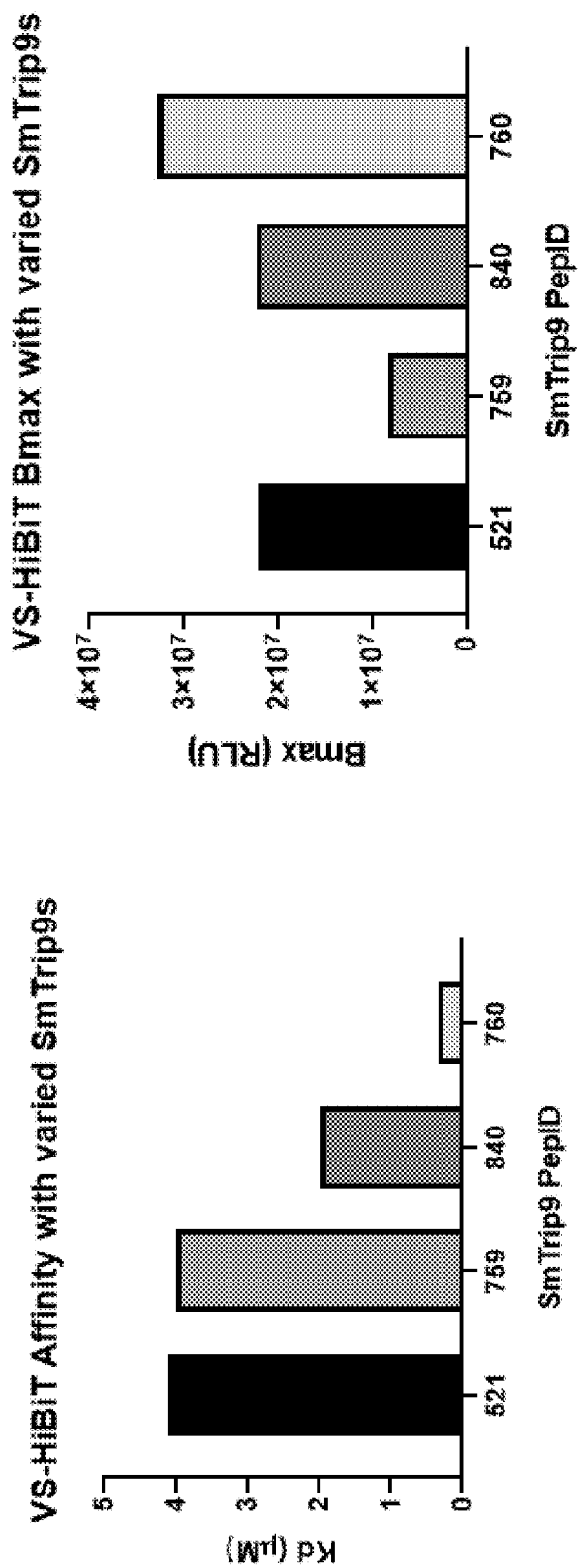

FIG. 161. LgTrip was diluted to 0.2 nM in TBS+0.01% BSA+0.01% Tergitol and pep289 was added to 25 uM. This solution was used as the diluent for 5-fold serial dilution series of SmTrip9 peptides. Samples were equilibrated 10 min at room temperature and aliquoted into assay plates in triplicate. TBS+0.01% BSA+0.01% Tergitol containing 20 uM furimazine was added to samples in 1:1 vol:vol ratio. Plates were incubated 10 min, and luminescence was read. To determine VS-HiBiT Kd, the same protocol was followed, but with saturating SmTrip9 (20× Kd) and titration of VS-HiBiT.

Figure 162:
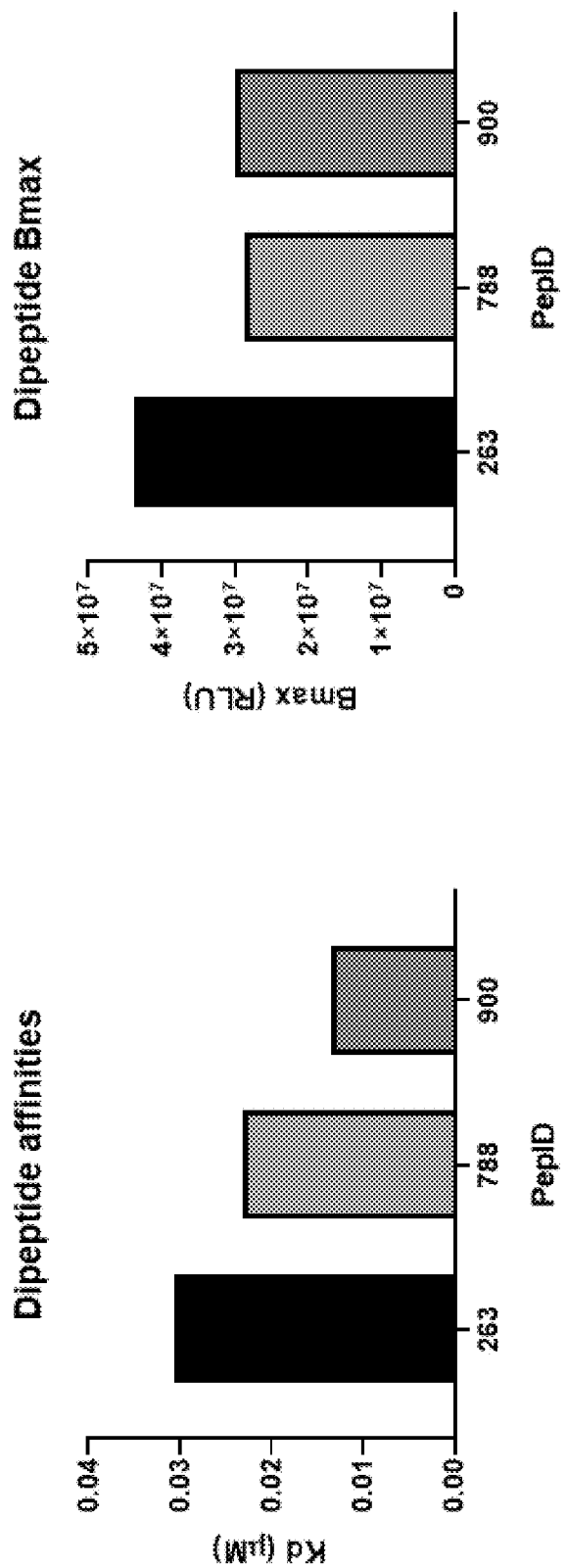

FIG. 162. Dipeptides were diluted to 5 uM and diluted serially 5-fold using TBS+0.01% BSA+0.01% Tergitol with 0.2 nM of LgTrip as the diluent. Samples were incubated 10 minutes at room temperature and added to assay plates in triplicate. One-to-one vol:vol of TBS+0.01% BSA+0.01% Tergitol with 20× diluted live cell substrate was added to samples, and plates were read on a GloMax® luminometer after 10 minutes.

Figure 163:
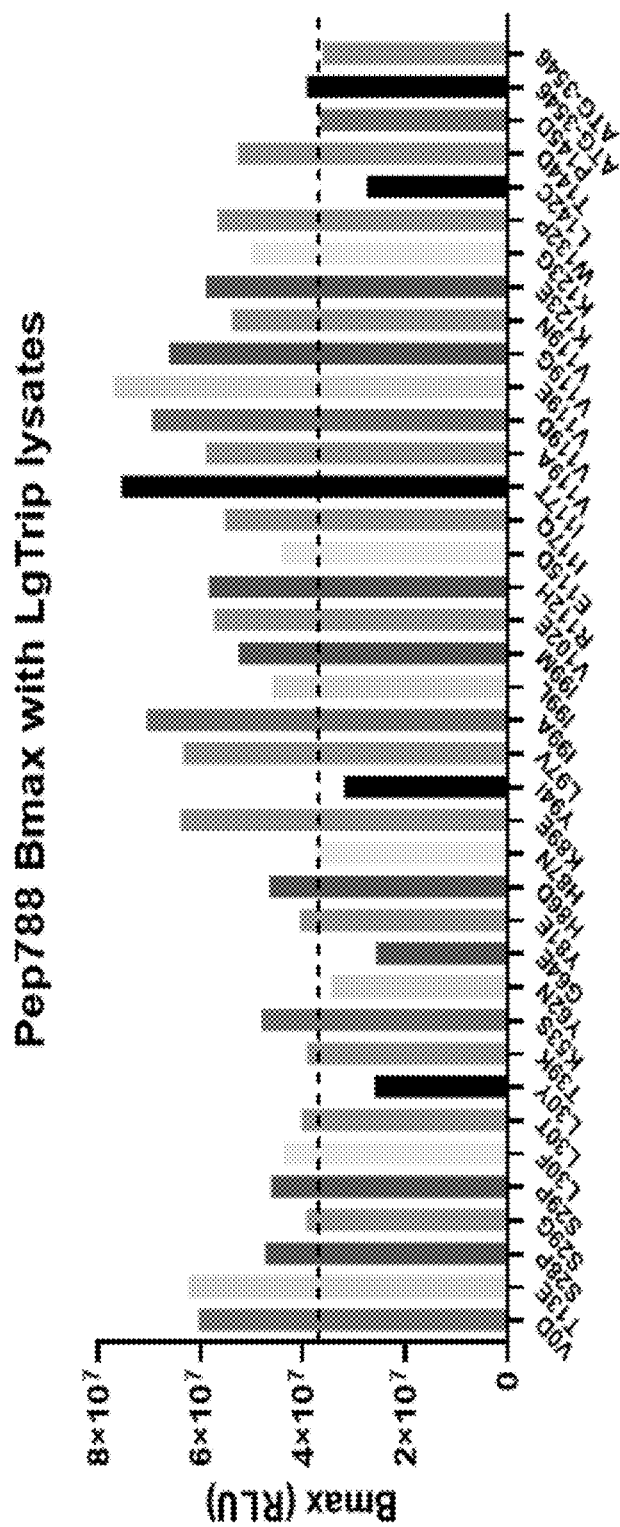

FIG. 163. LgTrip variants were grown overnight at 37° C. in LB with 100 µg/ml ampicillin. Cells were diluted 20-fold into induction media (LB with 100 µg/ml ampicillin and 0.1% rhamnose w/v) and induced 4 hours at 37° C. with shaking. Ten microliters of each induction was diluted into 250 ul lysis buffer (0.3× PLB+25 mM HEPES pH 7.5). Eighty microliters of lysates were diluted further in 2 ml lysis buffer. A 10-fold dilution series of pep788 (SEQ ID 414) was performed stating at 10 pM peptide using Nano-Glo with 50 uM furimazine as the diluent. Peptide dilutions and lysates were mixed 1:1 vol:vol, incubated 10 min at room temperature, and luminescence was read.

Figure 164:
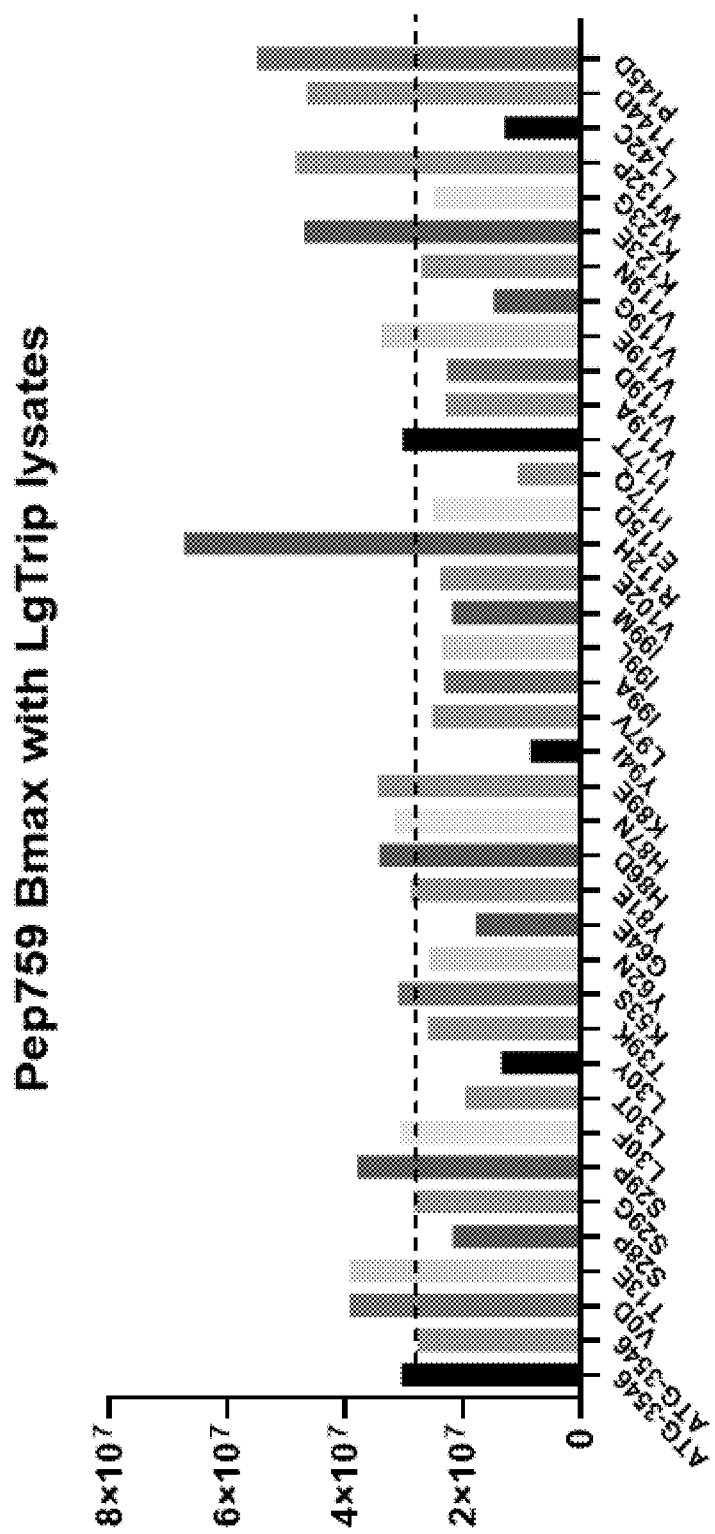

FIG. 164. LgTrip variants were grown overnight at 37° C. in LB with 100 µg/ml ampicillin. Cells were diluted 20-fold into induction media (LB with 100 µg/ml ampicillin and 0.1% rhamnose w/v) and induced 4 hours at 37° C. with shaking. Ten microliters of each induction was diluted into 250 ul lysis buffer (0.3× PLB+25 mM HEPES pH 7.5). Eighty microliters of lysates were diluted further in 2 ml lysis buffer. A 5-fold dilution series of pep759 (SEQ ID 496) was performed at 50 pM peptide using Nano-Glo with 50 uM furimazine and 50 pM pep289 (SEQ ID 826) as the diluent. Peptide dilutions and lysates were mixed 1:1 vol:vol, incubated 10 min at room temperature, and luminescence was read.

Figure 165:
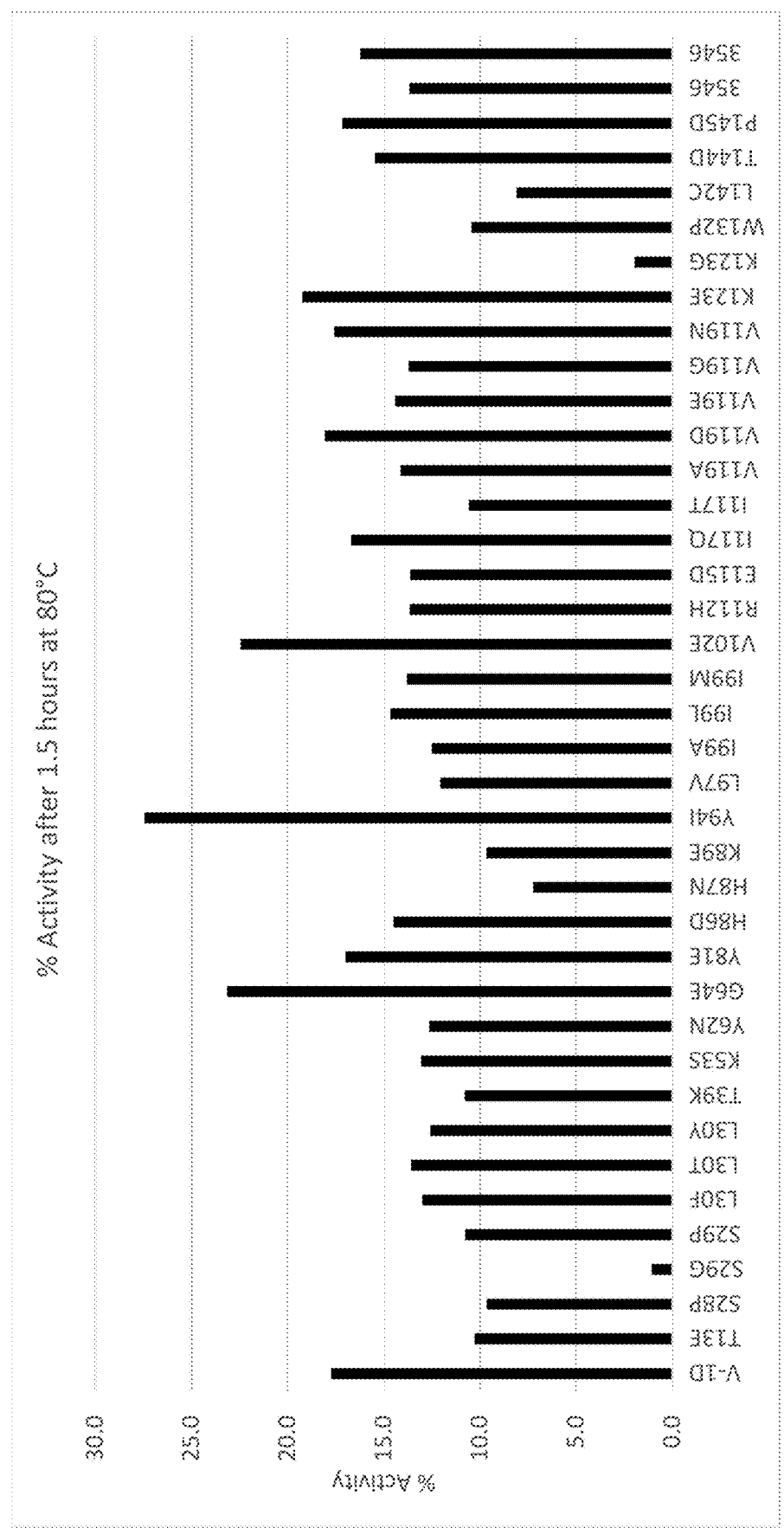

FIG. 165. LgTrip variants were grown overnight at 37° C. in LB with 100 µg/ml ampicillin. Cells were diluted 20-fold into induction media (LB with 100 µg/ml ampicillin and 0.1% rhamnose w/v) and induced 20 hours at 25° C. with shaking. Twenty microliters of each induction was diluted into 40 ul lysis buffer (0.3× PLB+25 mM HEPES pH 7.5) and lysed for 15 min at room temperature. Lysates were diluted 1,000-fold into 1× TBS+0.01% BSA. Fifty microliters of each sample was transferred into a PCR plate and incubated at 80° C. for 1.5 hrs in a thermocycler. Controls were incubated on ice. Samples were equilibrated to room temperature and diluted 1:100 into 1× TBS+0.01% BSA. Twenty-five microliters of each sample were transferred into assay plates and mixed with 25 ul of 400 nM pep788 (SEQ ID 414) in TBS+0.01% BSA+20× diluted live cell substrate. Samples were incubated 10 minutes at room temperature, and luminescence was read.

Figure 166:
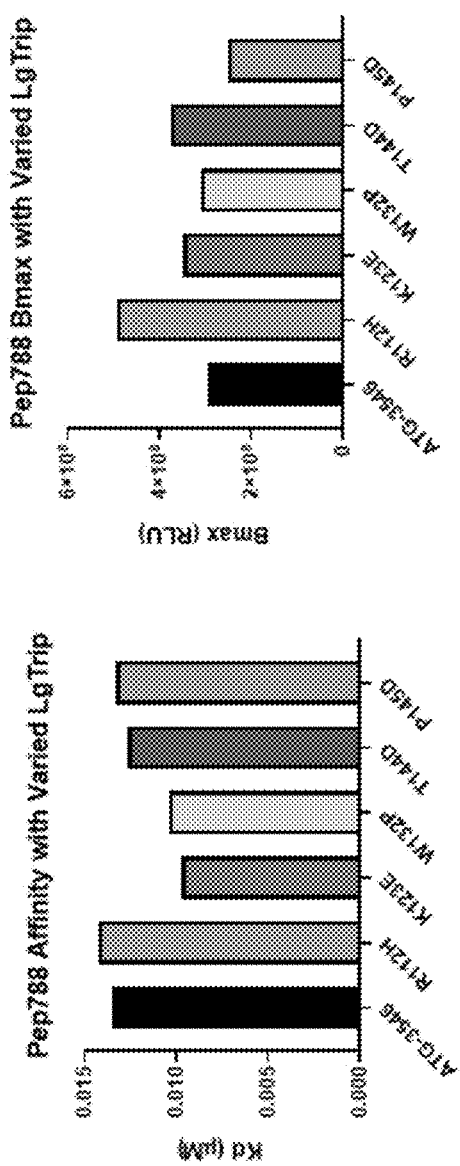

FIG. 166. LgTrip variants were purified using the Promega MagneHis™ Protein Purification system according to the manufacturer's protocol and diluted to 0.2 nM in TBS+ 0.01% BSA+0.01% Tergitol+25 uM pep289. This solution was used as the diluent for 5-fold serial dilution series of SmTrip9 peptides. Samples were equilibrated 10 min at room temperature and aliquoted into assay plates in triplicate. TBS+0.01% BSA+0.01% Tergitol containing 20 uM furimazine was added to samples in 1:1 vol:vol ratio. Plates were incubated 10 min, and luminescence was read. To determine VS-HiBiT Kd, the same protocol was followed, but with saturating SmTrip9 (25 uM) and titration of VS-HiBiT.

Figure 167:
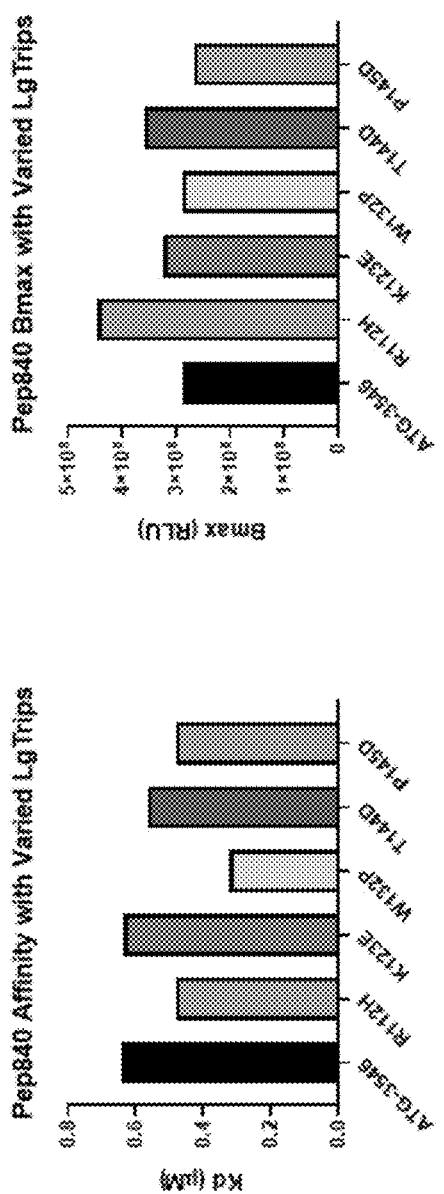

FIG. 167. LgTrip variants were purified using the Promega MagneHis™ Protein Purification system according to the manufacturer's protocol and diluted to 0.2 nM in TBS+ 0.01% BSA+0.01% Tergitol+25 uM pep289. This solution was used as the diluent for 5-fold serial dilution series of SmTrip9 peptides. Samples were equilibrated 10 min at room temperature and aliquoted into assay plates in triplicate. TBS+0.01% BSA+0.01% Tergitol containing 20 uM furimazine was added to samples in 1:1 vol:vol ratio. Plates were incubated 10 min, and luminescence was read. To determine VS-HiBiT Kd, the same protocol was followed, but with saturating SmTrip9 (25 uM) and titration of VS-HiBiT.

Figure 168:
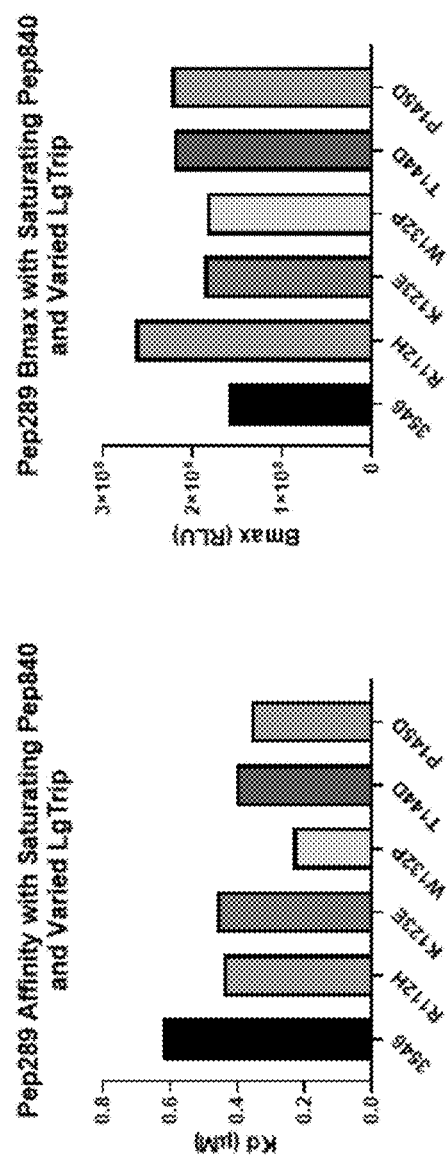

FIG. 168. LgTrip variants were purified using the Promega MagneHis™ Protein Purification system according to the manufacturer's protocol and diluted to 0.2 nM in TBS+ 0.01% BSA+0.01% Tergitol+25 uM pep289. This solution was used as the diluent for 5-fold serial dilution series of SmTrip9 peptides. Samples were equilibrated 10 min at room temperature and aliquoted into assay plates in triplicate. TBS+0.01% BSA+0.01% Tergitol containing 20 uM furimazine was added to samples in 1:1 vol:vol ratio. Plates were incubated 10 min, and luminescence was read. To determine VS-HiBiT Kd, the same protocol was followed, but with saturating SmTrip9 (12.5 uM) and titration of VS-HiBiT.

Figure 169:
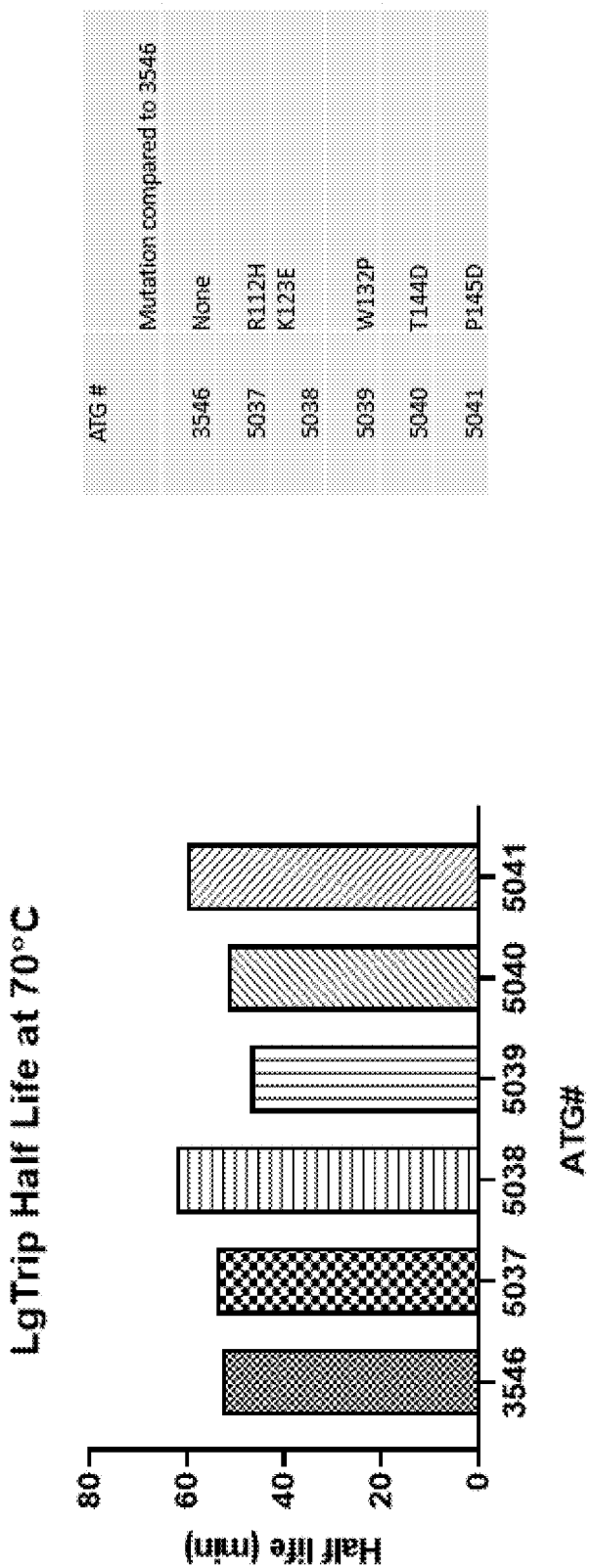

FIG. 169. MagneHis purified LgTrip variants were diluted to 20 nM in TBS+0.01% BSA. In triplicate, 100 µl aliquots of each sample were loaded into 200 µl thin walled PCR tubes. Samples were incubated at 70° C. in thermal cycler. Samples were removed at various time-points and equilibrated to room temperature. Samples were diluted to 0.2 nM (5 µl in 495 µl) in TBS+0.01% BSA. 25 µl of each diluted sample was combined with 25 µl of TBS+0.01% BSA+20× diluted live cell substrate furimazine+400 nM pep788 (SEQ ID NO: 414). Samples were incubated for 10 minutes and then read on GMM+. Half-life was calculated by non-linear regression.

Figure 170:
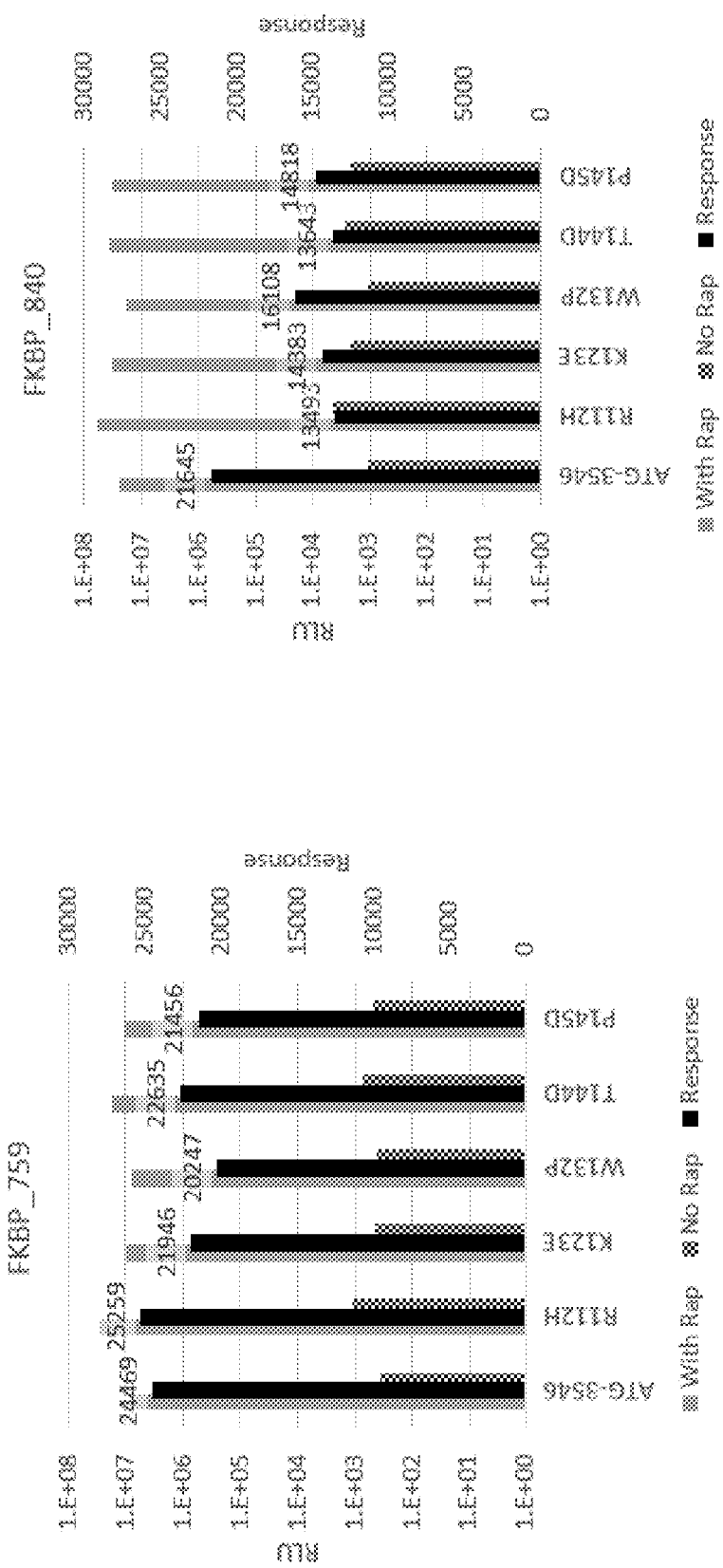

FIG. 170. Cultures of FKBP_SmTrip9 variants and FRB-SmTrip10 s were grown overnight in LB+100 µg/ml ampicillin at 37° C. Cells were diluted 1:20 in LB with 0.15% glucose, 0.1% rhamnose, and 100 ug/ml ampicillin. Cultures were induced ~20 hr at 25° C. with shaking. PLB assay reagent was prepared with 444 nM of a MagneHis purified LgTrip variants, 90× diluted FRB-SmTrip10 culture, +/−35 nM Rapamycin. Ninety microliters of assay reagent was added to each well of 96-well assay plates. FKBP_SmTrip9 cultures were diluted 1:10 in PLB, and 10 ul was added to assay plates. Samples were incubated 30 min at room temperature. One hundred microliters of Nano-Glo containing 50 uM furimazine was added to assay plates wells, and luminescence was read on GloMax® luminometer after 5 minutes.

Figure 171:
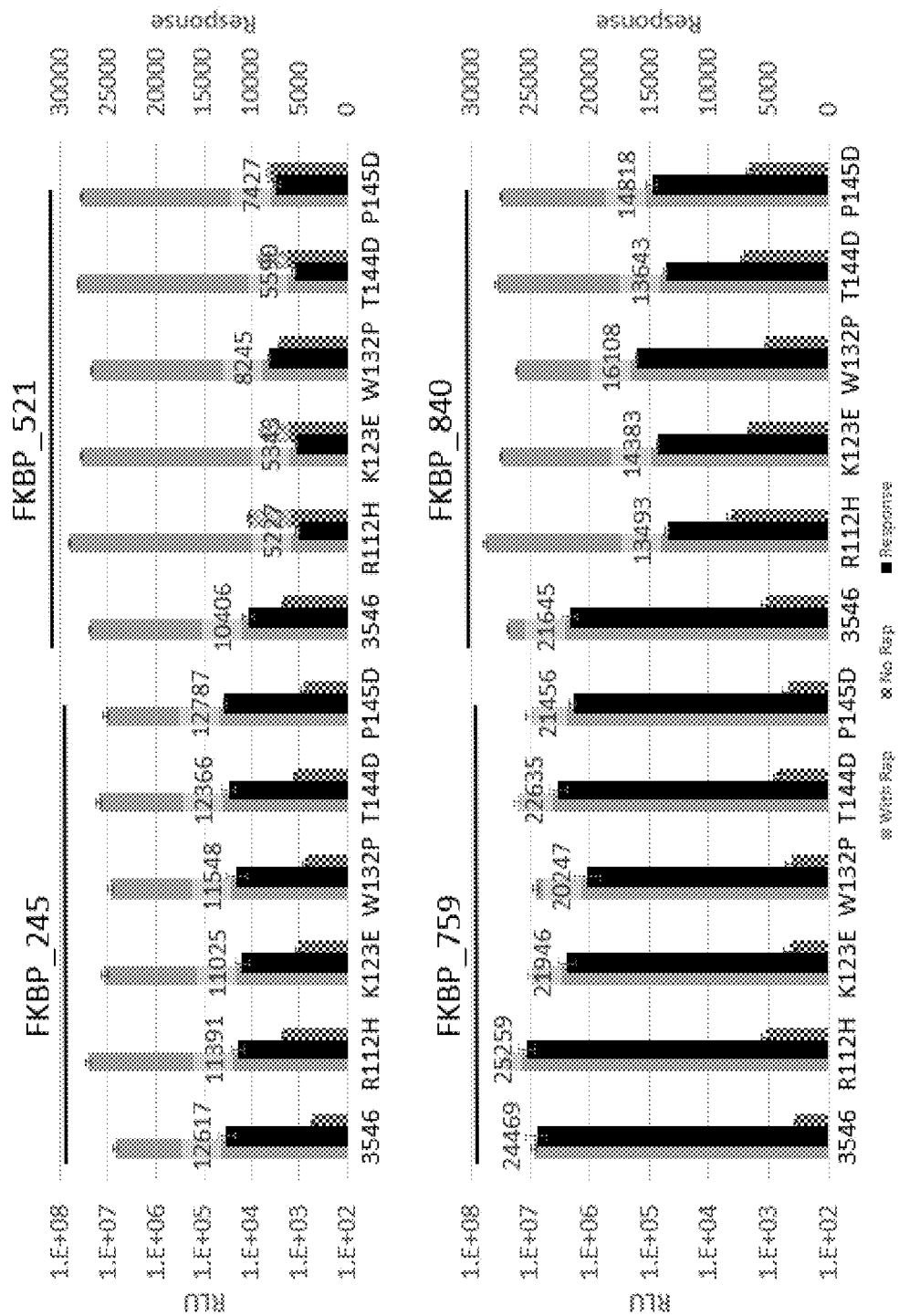

FIG. 171. Cultures of FKBP_SmTrip9 variants and FRB-SmTrip10 s were grown overnight in LB+100 µg/ml ampicillin at 37° C. Cells were diluted 1:20 in LB with 0.15% glucose, 0.1% rhamnose, and 100 ug/ml ampicillin. Cultures were induced ~20 hr at 25° C. with shaking. PLB assay reagent was prepared with 444 nM of a MagneHis purified LgTrip variant, 90× diluted FRB-SmTrip10 culture, +/−35 nM Rapamycin. Ninety microliters of assay reagent was added to each well of 96-well assay plates. FKBP_SmTrip9 cultures were diluted 1:10 in PLB, and 10 ul was added to assay plates. Samples were incubated 30 min at room temperature. One hundred microliters of Nano-Glo containing 50 uM furimazine was added to assay plates wells, and luminescence was read on GloMax® luminometer after 5 minutes.

Figure 172:
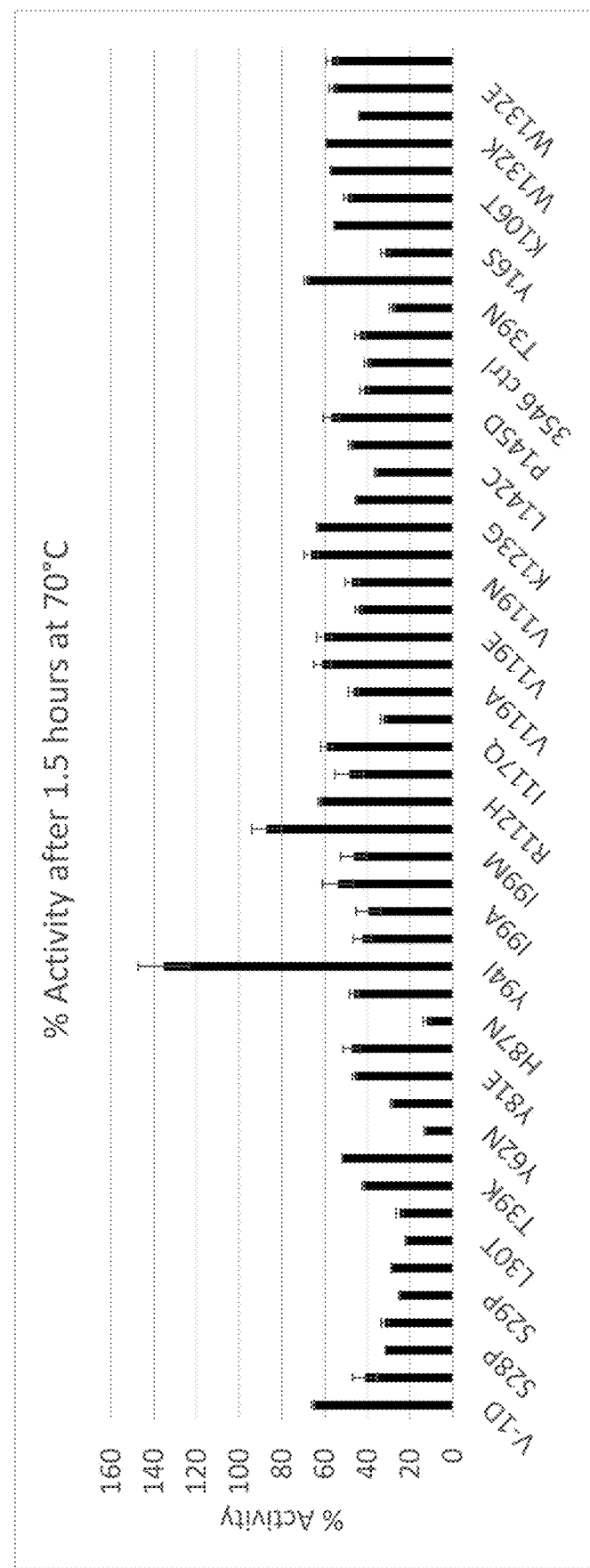

FIG. 172. LgTrip variants were grown overnight at 37° C. in LB with 100 µg/ml ampicillin. Cells were diluted 20-fold into induction media (LB with 100 µg/ml ampicillin and 0.1% rhamnose w/v) and induced 20 hours at 25° C. with shaking. Twenty microliters of each induction was diluted into 40 ul lysis buffer (0.3× PLB+25 mM HEPES pH 7.5) and lysed for 15 min at room temperature. Lysates were diluted 1,000-fold into 1× TBS+0.01% BSA. Fifty microliters of each sample was transferred into a PCR plate and incubated at 70° C. for 1.5 hrs in a thermocycler. Controls were incubated on ice. Samples were equilibrated to room temperature and diluted 1:100 into 1× TBS+0.01% BSA. Twenty-five microliters of each sample were transferred into assay plates and mixed with 25 ul of 400 nM pep788 (SEQ ID 414) in TBS+0.01% BSA+20× diluted live cell furimazine substrate. Samples were incubated 10 minutes at room temperature, and luminescence was read.

Figure 173:
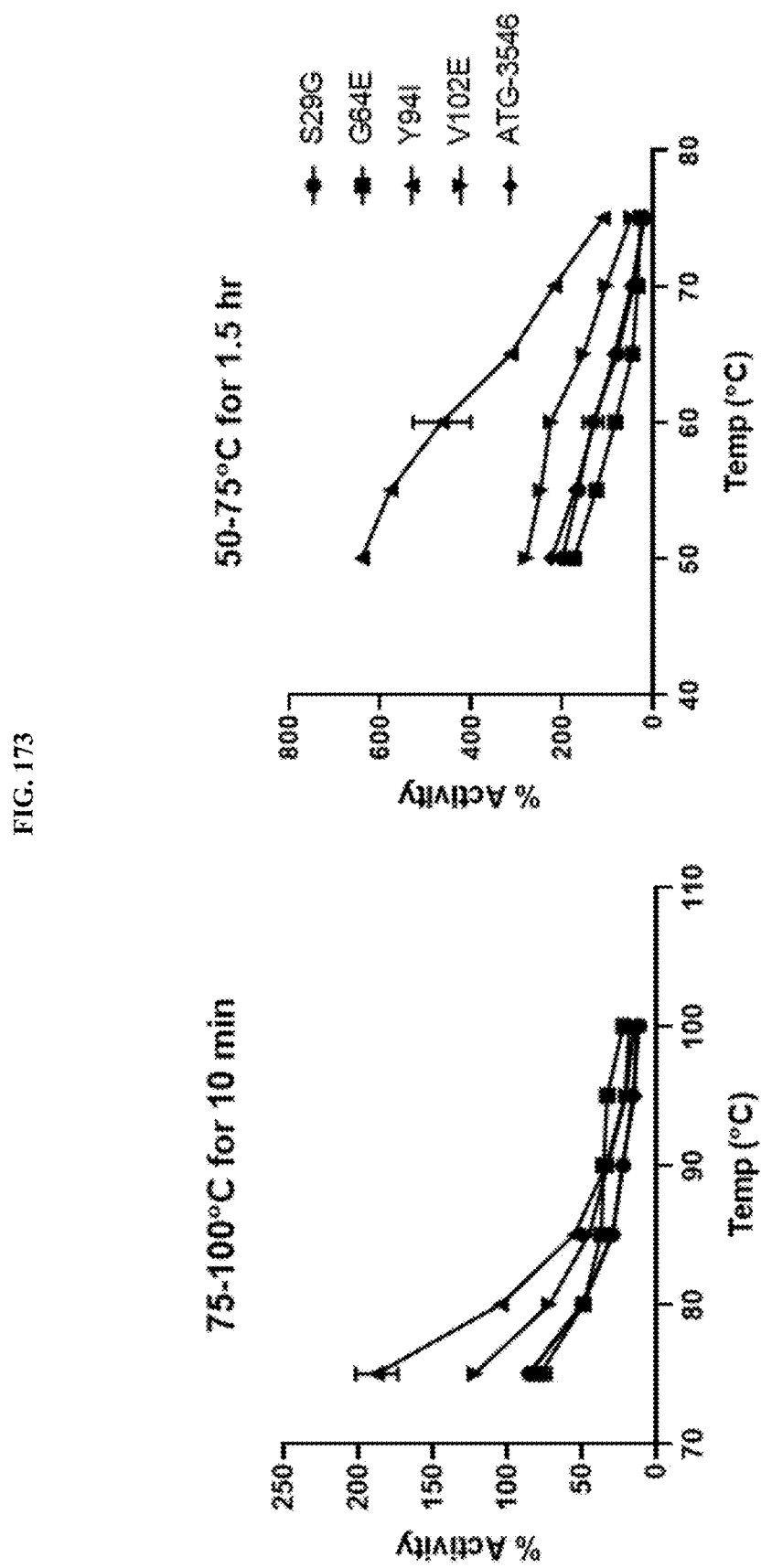

FIG. 173. LgTrip variants were grown overnight at 37° C. in LB with 100 µg/ml ampicillin. Cells were diluted 20-fold into induction media (LB with 100 µg/ml ampicillin and 0.1% rhamnose w/v) and induced 20 hours at 25° C. with shaking. Twenty microliters of each induction was diluted into 40 ul lysis buffer (0.3× PLB+25 mM HEPES pH 7.5) and lysed for 15 min at room temperature. Lysates were diluted 1,000-fold into 1× TBS+0.01% BSA. Fifty microliters of each sample was transferred into a PCR plate and incubated at two temperature gradients, either 75-100° C. for 10 min or 50-75° C. for 1.5 hr, in a Veritas thermocycler. Controls were incubated on ice. Samples were equilibrated to room temperature and diluted 1:100 into 1× TBS+0.01% BSA. Twenty-five microliters of each sample were transferred into assay plates and mixed with 25 ul of 400 nM pep788 (SEQ ID 414) in TBS+0.01% BSA+20× diluted live cell furimazine substrate. Samples were incubated 10 minutes at room temperature, and luminescence was read.

Figure 174:
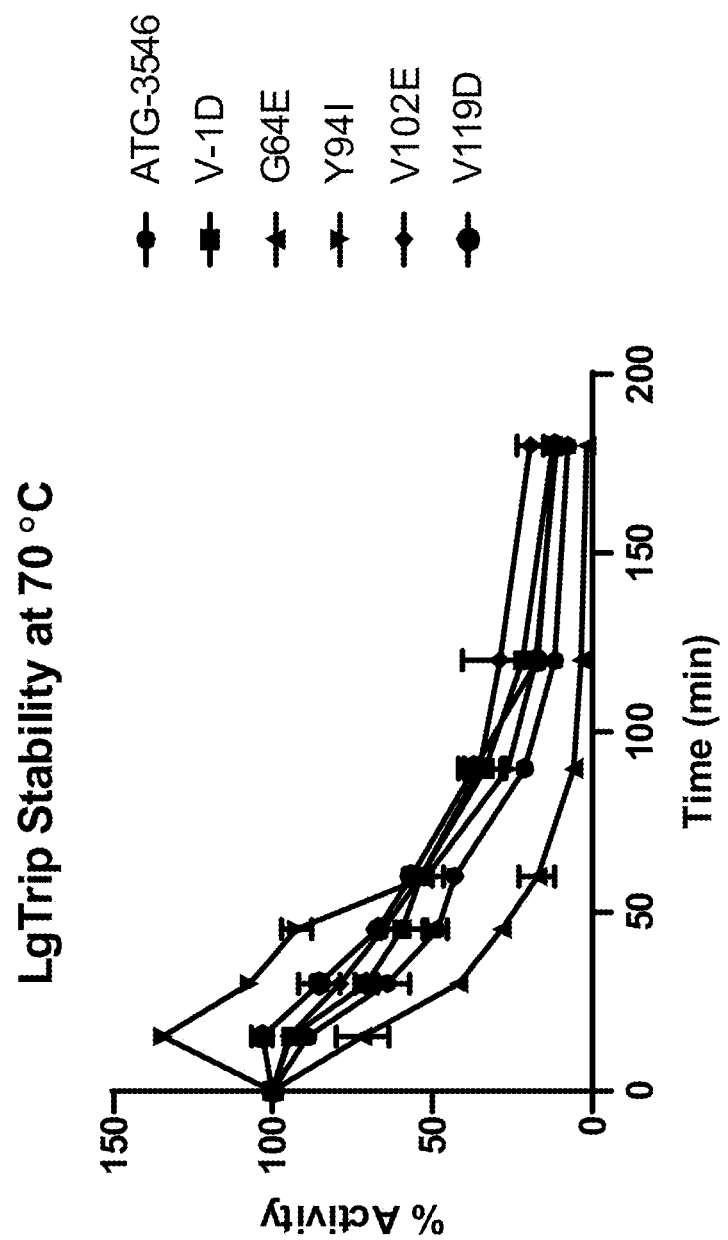

FIG. 174. MagneHis purified LgTrip variants were diluted to 20 nM in TBS+0.01% BSA. In triplicate, 100 µl aliquots of each sample were loaded into 200 µl thin walled PCR tubes. Samples were incubated at 70° C. in a thermal cycler. Samples were removed at various time-points and equilibrated to room temperature. Samples were diluted to 0.2 nM (5 in 495p1) in TBS+0.01% BSA. 25 µl of each diluted sample was combined with 25 µl of TBS+0.01% BSA+20× diluted live cell substrate furimazine+400 nM pep788 (SEQ ID NO: 414). Samples were incubated for 10 minutes and then read on GMM+.

Figure 175:
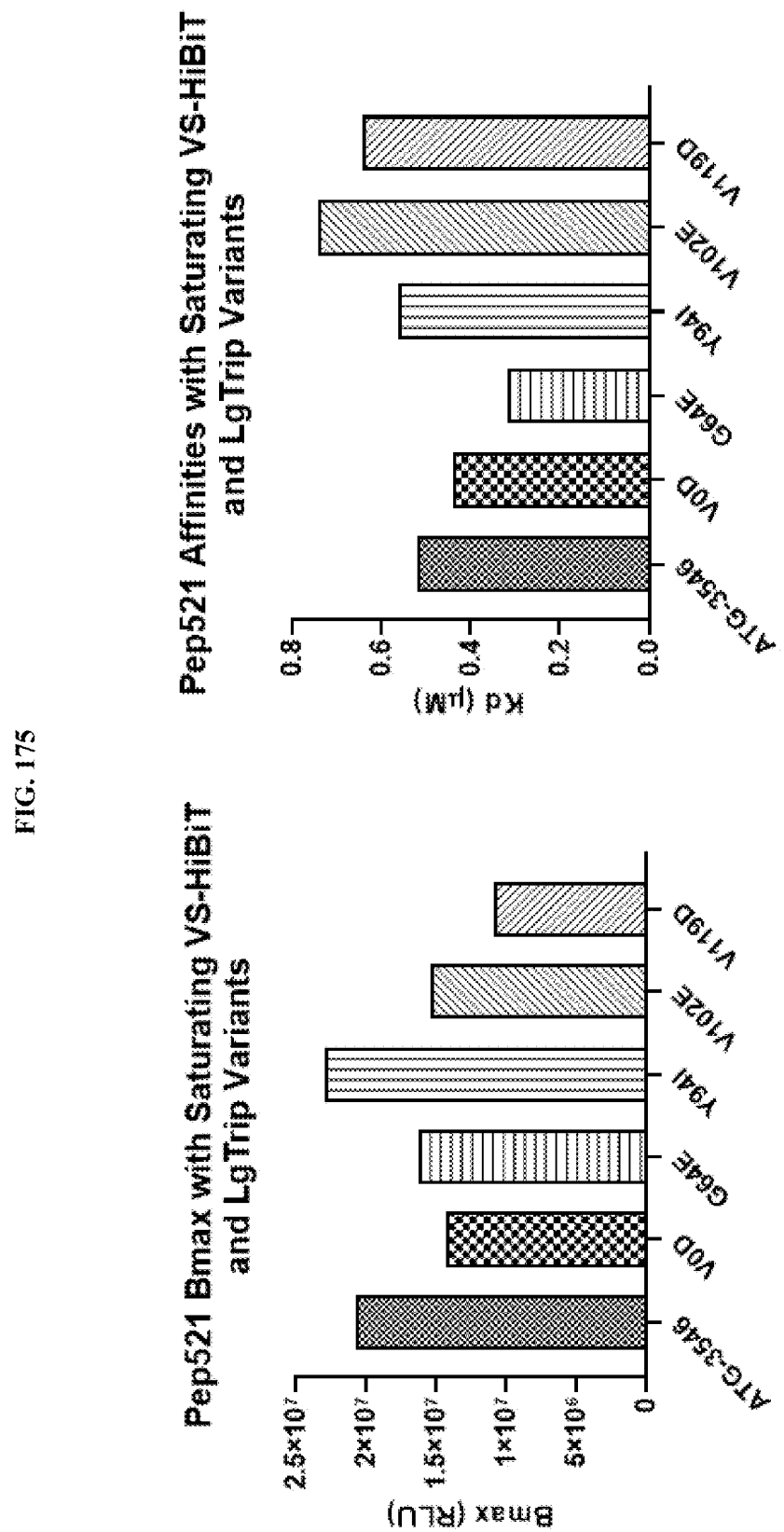

FIG. 175. LgTrip variants were purified using the Promega MagneHis™ Protein Purification system according to the manufacturer's protocol and diluted to 0.2 nM in TBS+0.01% BSA+0.01% Tergitol+25 uM pep289. This solution was used as the diluent for 5-fold serial dilution series of SmTrip9 peptides. Samples were equilibrated 10 min at room temperature and aliquoted into assay plates in triplicate. TBS+0.01% BSA+0.01% Tergitol containing 20 uM furimazine was added to samples in 1:1 vol:vol ratio. Plates were incubated 10 min, and luminescence was read. To determine VS-HiBiT Kd, the same protocol was followed, but with saturating SmTrip9 (12.5 uM) and titration of VS-HiBiT.

FIG. 176. LgTrip variants were purified using the Promega MagneHis™ Protein Purification system according to the manufacturer's protocol and diluted to 0.2 nM in TBS+0.01% BSA+0.01% Tergitol+25 uM pep289. This solution was used as the diluent for 5-fold serial dilution series of SmTrip9 peptides. Samples were equilibrated 10 min at room temperature and aliquoted into assay plates in triplicate. TBS+0.01% BSA+0.01% Tergitol containing 20 uM furimazine was added to samples in 1:1 vol:vol ratio. Plates were incubated 10 min, and luminescence was read. To determine VS-HiBiT Kd, the same protocol was followed, but with saturating SmTrip9 (12.5 uM) and titration of VS-HiBiT.

FIG. 177. LgTrip variants were purified using the Promega MagneHis™ Protein Purification system according to the manufacturer's protocol and diluted to 0.2 nM in TBS+0.01% BSA+0.01% tergitol+25 uM pep289. This solution was used as the diluent for 5-fold serial dilution series of SmTrip9 peptides. Samples were equilibrated 10 min at room temperature and aliquoted into assay plates in triplicate. TBS+0.01% BSA+0.01% tergitol containing 20 uM furimazine was added to samples in 1:1 vol:vol ratio. Plates were incubated 10 min, and luminescence was read. To determine VS-HiBiT Kd, the same protocol was followed, but with saturating SmTrip9 (25 uM) and titration of VS-HiBiT.

FIG. 178. LgTrip variants were purified according to using the Promega MagnaHisMagneHis™ Protein Purification system according to the manufacturer's protocol and diluted to 0.2 nM in TBS+0.01% BSA+0.01% Tergitol+25 uM pep289. This solution was used as the diluent for 5-fold serial dilution series of SmTrip9 peptides. Samples were equilibrated 10 min at room temperature and aliquoted into assay plates in triplicate. TBS+0.01% BSA+0.01% Tergitol containing 20 uM furimazine was added to samples in 1:1 vol:vol ratio. Plates were incubated 10 min, and luminescence was read. To determine VS-HiBiT Kd, the same protocol was followed, but with saturating SmTrip9 (25 uM) and titration of VS-HiBiT.

FIG. 179. LgTrip variants were purified according to using the Promega MagnaHisMagneHis™ Protein Purification system according to the manufacturer's protocol and diluted to 0.2 nM in TBS+0.01% BSA+0.01% tergitol+25 uM pep289. This solution was used as the diluent for 5-fold serial dilution series of SmTrip9 peptides. Samples were equilibrated 10 min at room temperature and aliquoted into assay plates in triplicate. TBS+0.01% BSA+0.01% tergitol containing 20 uM furimazine was added to samples in 1:1 vol:vol ratio. Plates were incubated 10 min, and luminescence was read. To determine VS-HiBiT Kd, the same protocol was followed, but with saturating SmTrip9 (20× Kd) and titration of VS-HiBiT.

FIG. 180. LgTrip variants were purified according to using the Promega MagnaHisMagneHis™ Protein Purification system according to the manufacturer's protocol and diluted to 0.2 nM in TBS+0.01% BSA+0.01% Tergitol+25 uM pep289. This solution was used as the diluent for 5-fold serial dilution series of SmTrip9 peptides. Samples were equilibrated 10 min at room temperature and aliquoted into assay plates in triplicate. TBS+0.01% BSA+0.01% Tergitol containing 20 uM furimazine was added to samples in 1:1 vol:vol ratio. Plates were incubated 10 min, and luminescence was read. To determine VS-HiBiT Kd, the same protocol was followed, but with saturating SmTrip9 (20× Kd) and titration of VS-HiBiT.

Figure 181:
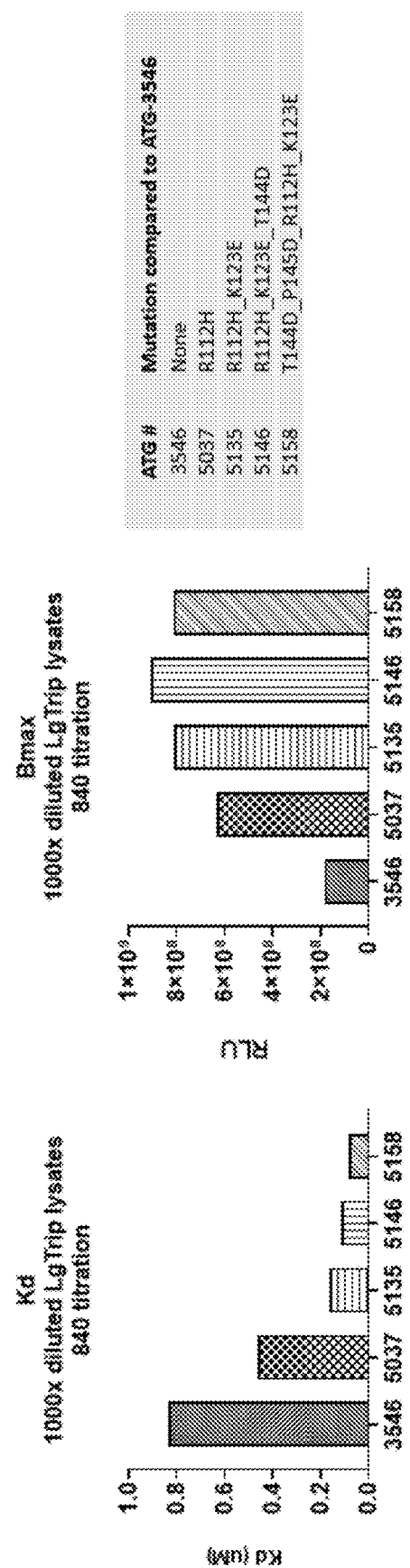

FIG. 181. LgTrip variant cultures were grown overnight in LB+100 µg/ml ampicillin at 37° C. Cells were diluted 1:20 in LB with 0.15% glucose, 0.1% rhamnose, and 100 ug/ml ampicillin and induced ~20 hr at 25° C. with shaking. Cells were diluted 1000× in PLB assay reagent (0.3× PLB+25 mM HEPES pH 7.5) and lysed for 20 min. Five-fold serial dilutions of SmTrip9 pep840 were performed in Nano-Glo+50 uM furimazine+25 uM pep289 and mixed 1:1 vol:vol with LgTrip lysates. Samples were incubated 10 min at room temperature and read on GloMax® luminometer.

Figure 182:
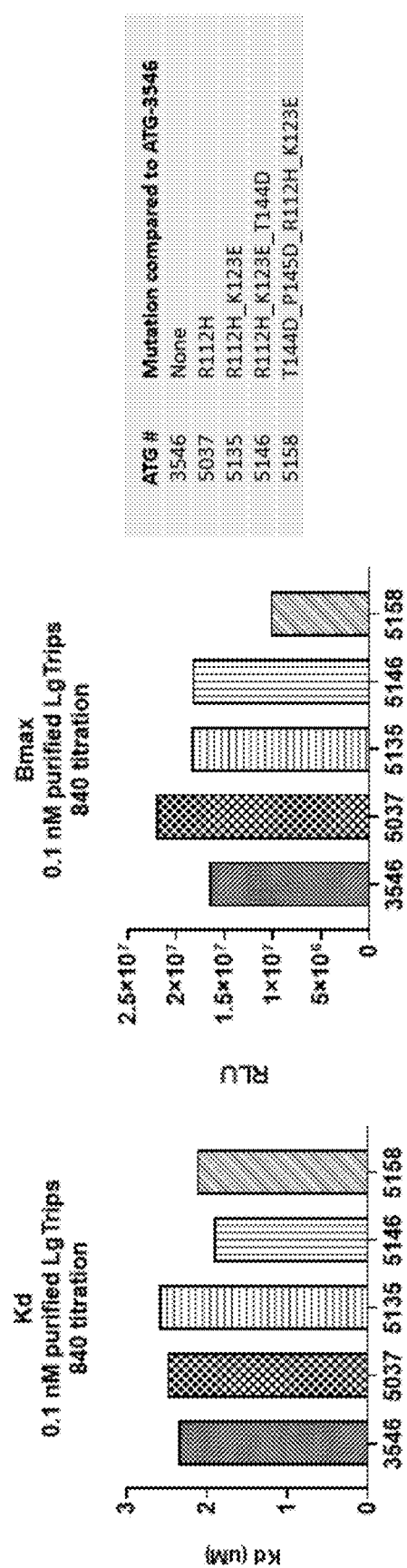

FIG. 182. LgTrip variants were purified according to using the Promega MagnaHisMagneHis™ Protein Purification system according to the manufacturer's protocol and diluted to 0.2 nM in TBS+0.01% BSA+0.01% Tergitol+25 uM pep289. This solution was used as the diluent for 5-fold serial dilution series of SmTrip9 peptides. Samples were equilibrated 10 min at room temperature and aliquoted into assay plates in triplicate. TBS+0.01% BSA+0.01% Tergitol containing 20 uM furimazine was added to samples in 1:1 vol:vol ratio. Plates were incubated 10 min, and luminescence was read. To determine VS-HiBiT Kd, the same protocol was followed, but with saturating SmTrip9 (25 uM) and titration of VS-HiBiT.

Figure 183:
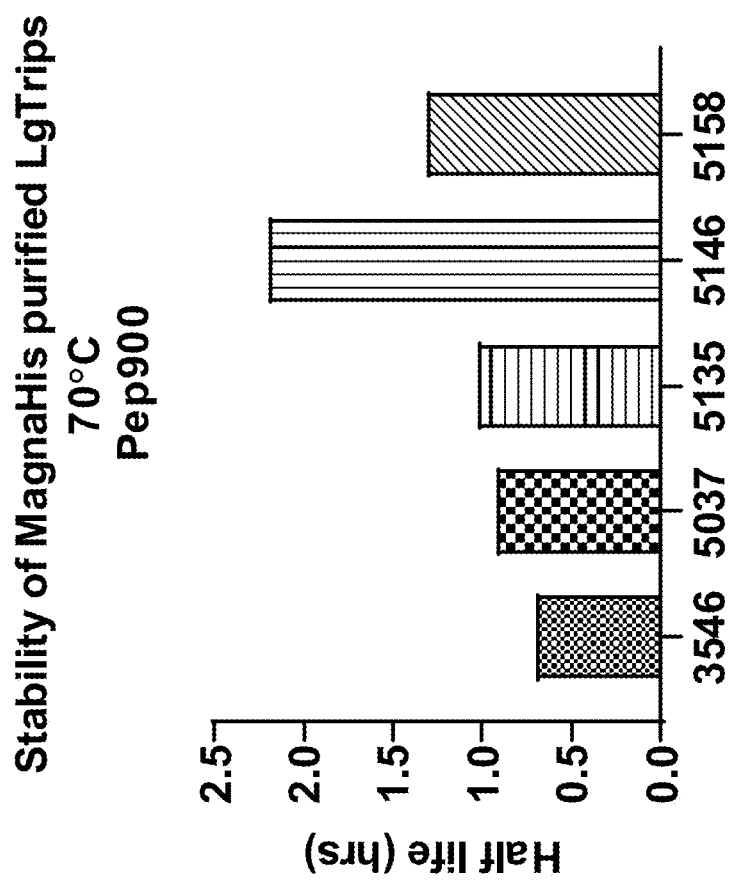

FIG. 183. MagneHis purified LgTrip variants were diluted to 20 nM in TBS+0.01% BSA. In triplicate, 100 μl aliquots of each sample were loaded into 200 μl thin walled PCR tubes. Samples were incubated at 70° C. in a thermal cycler. Samples were removed at various time-points and equilibrated to room temperature. Samples were diluted to 0.2 nM (5 in 495 μl) in TBS+0.01% BSA. 25 μl of each diluted sample was combined with 25 μl of TBS+0.01% BSA+20× diluted live cell substrate furimazine+200 nM pep900 (SEQ ID NO: 907). Samples were incubated for 10 minutes and then read on GMM+. Half-life was calculated by non-linear regression.

Figure 184:
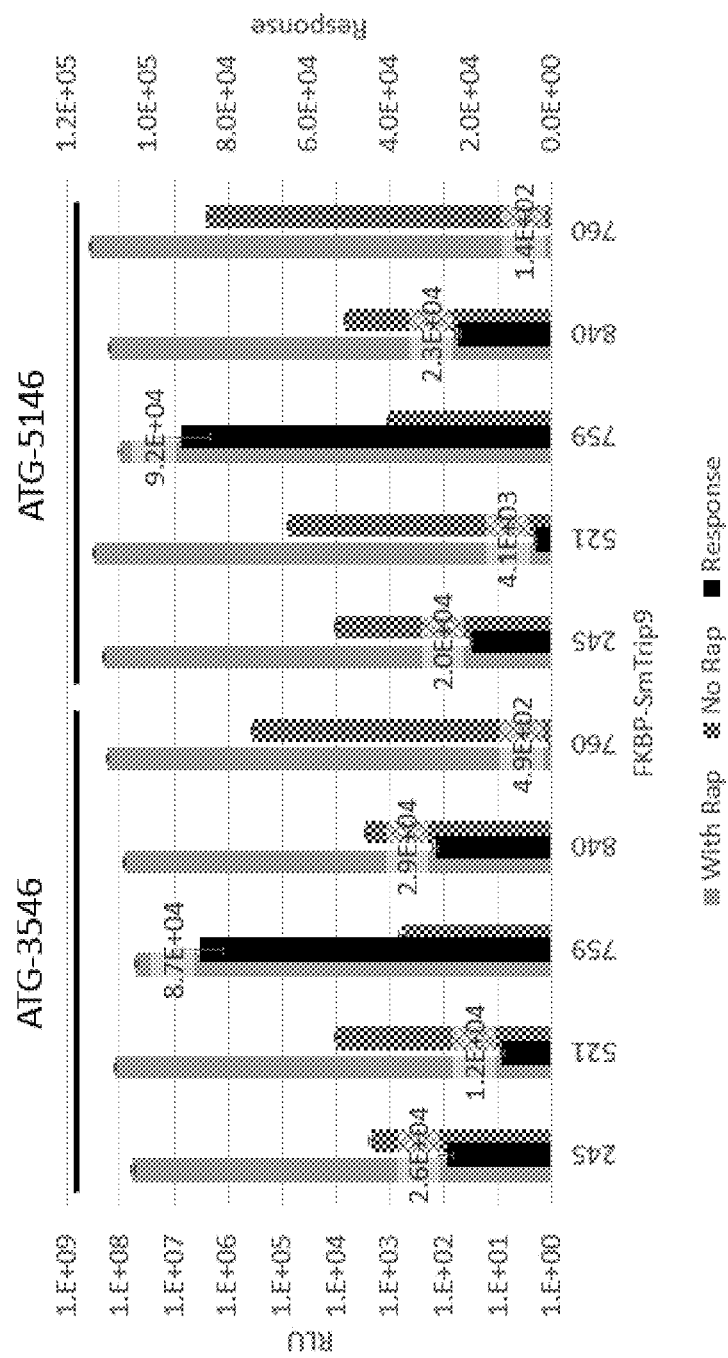

FIG. 184. Cultures of FKBP_SmTrip9 variants and FRB-SmTrip10 s were grown overnight in LB+100 μg/ml ampicillin at 37° C. Cells were diluted 1:20 in LB with 0.15% glucose, 0.1% rhamnose, and 100 ug/ml ampicillin. Cultures were induced ~20 hr at 25° C. with shaking. PLB assay reagent was prepared with 444 nM of a MagneHis purified LgTrip variant, 90× diluted FRB-SmTrip10 culture, +/−35 nM Rapamycin. Ninety microliters of assay reagent was added to each well of 96-well assay plates. FKBP_SmTrip9 cultures were diluted 1:10 in PLB, and 10 ul was added to assay plates. Samples were incubated 30 min at room temperature. One hundred microliters of Nano-Glo containing 50 uM furimazine was added to assay plates wells, and luminescence was read on GloMax after 5 minutes.

Figure 185:
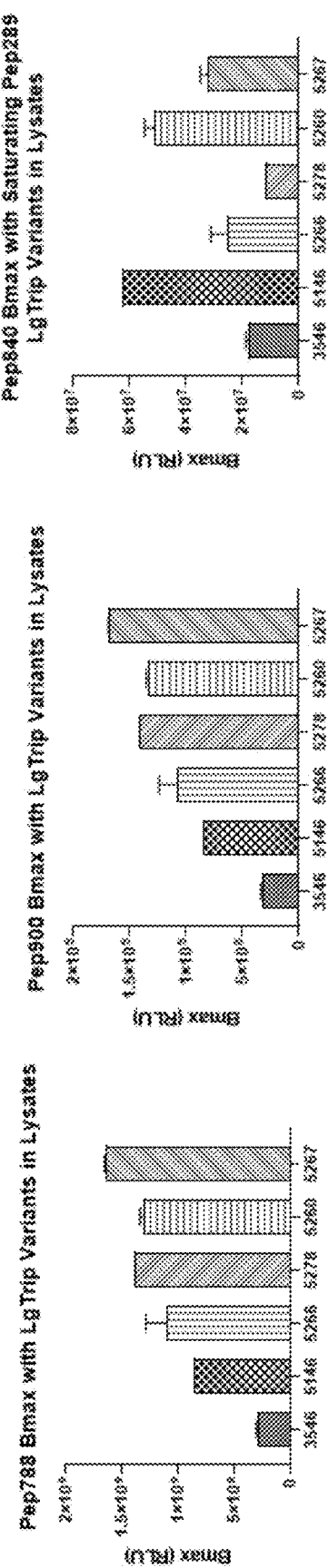

FIG. 185. LgTrip variant cultures were grown overnight in LB+100 μg/ml ampicillin at 37° C. Cells were diluted 1:20 in LB with 0.15% glucose, 0.1% rhamnose, and 100 ug/ml ampicillin and induced ~20 hr at 25° C. with shaking. Cells were diluted 5000× in 0.3× PLB assay reagent and lysed for 20 min. Five-fold serial dilutions of dipeptides pep788, pep900, or SmTrip9 pep840 with saturating pep289 were performed in Nano-Glo+50 uM furimazine and mixed 1:1 vol:vol with LgTrip variant lysates. Samples were incubated 10 min at room temperature and read on GloMax® luminometer. Bmax was calculated by non-linear regression.

Figure 186:
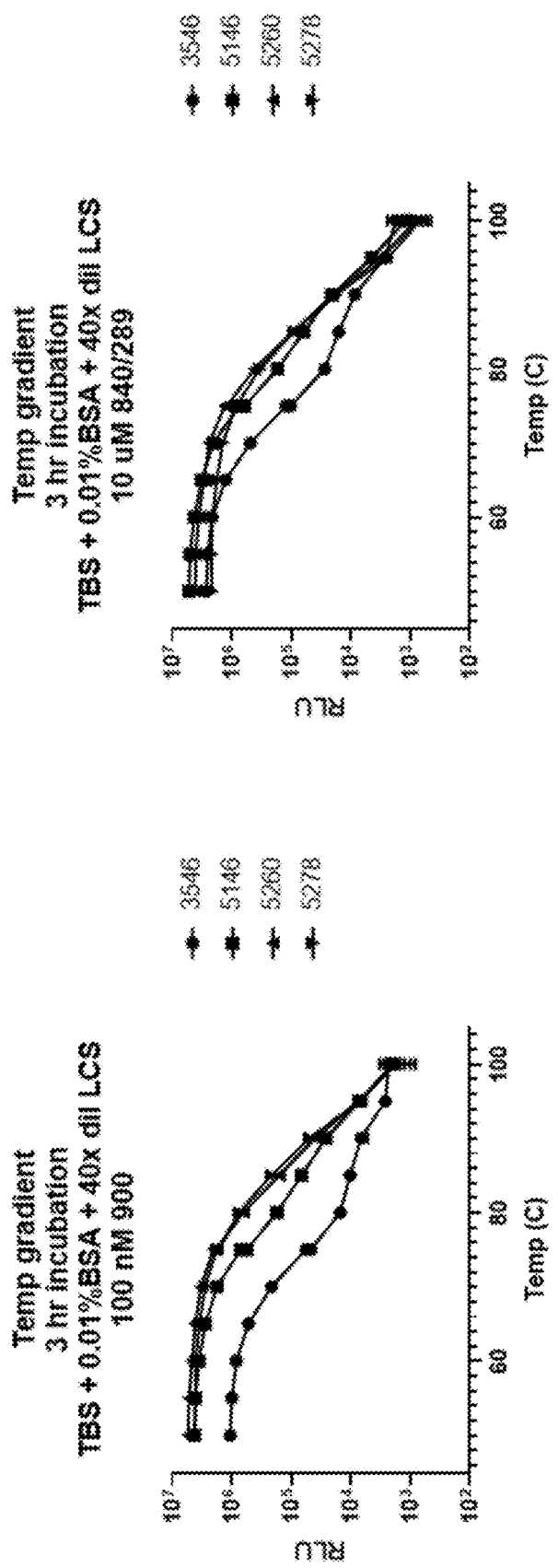

FIG. 186. LgTrip variants were diluted to 20 nM in 2 ml TBS+0.01% BSA, and 100 ul of each sample aliquoted into duplicate rows of 96-well PCR plates (two plates). Plates were incubated for 3 hrs at high (75-100° C.) or low (50-75° C.) temperature gradient in a Veritas thermocycler. Samples were placed at 70° C. and then aliquots moved to RT at various timepoints. Samples were equilibrated to RT. Samples at each timepoint were mixed with pipette and then diluted 1:100 into TBS+0.01% BSA(5 ul into 495 ul). 25 ul of each sample was aliquoted into a white assay plate, and 25 ul of 200 nM pep788 or pep900 in TBS+0.01% BSA+20× dil LCS added. The plate was incubated for 10 minutes and then luminescence read on GMM+.

Figure 187:
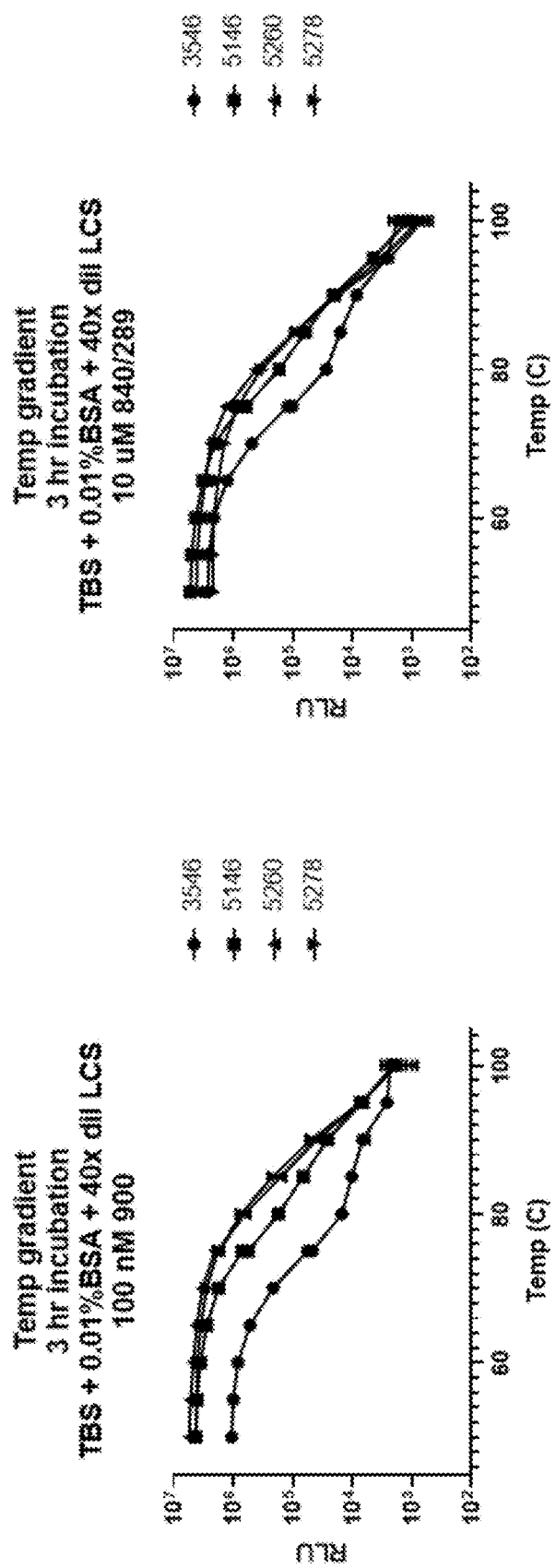

FIG. 187. Cultures of FKBP_SmTrip9 variants and FRB-SmTrip10 s were grown overnight in LB+100 μg/ml ampicillin at 37° C. Cells were diluted 1:20 in LB with 0.15% glucose, 0.1% rhamnose, and 100 ug/ml ampicillin. Cultures were induced ~20 hr at 25° C. with shaking. PLB assay reagent was prepared with 444 nM of a MagneHis purified LgTrip variant, 90× diluted FRB-SmTrip10 culture, and +/−35 nM Rapamycin. Ninety microliters of assay reagent was added to each well of 96-well assay plates. FKBP_SmTrip9 cultures were diluted 1:10 in PLB, and 10 ul was added to assay plates. Samples were incubated 30 min at room temperature. One hundred microliters of Nano-Glo containing 50 uM furimazine was added to assay plates wells, and luminescence was read on GloMax® luminometer after 5 minutes.

Figure 188:
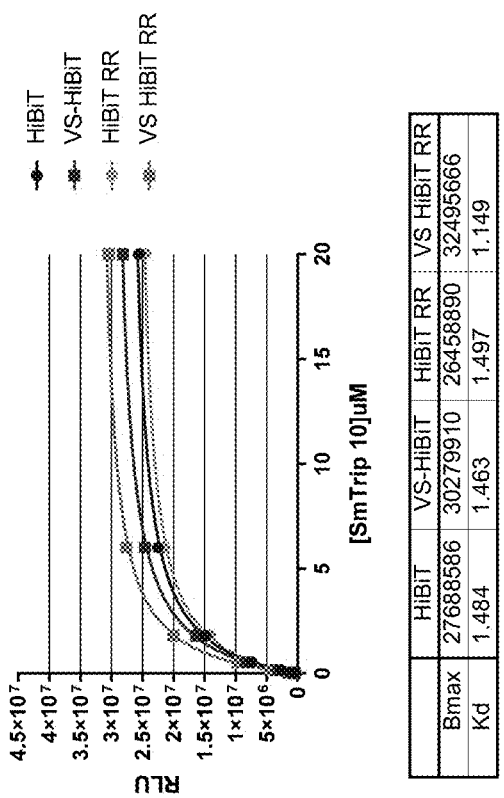

FIG. 188. LgTrip 3546 was diluted to 1 nM in OptiMEM+10% FBS. 12 pM solutions of strand 9 peptides 521 and 693 were prepared in OptiMem+10% FBS. Each strand 9 dilution was used to prepare 3-fold dilution series of each strand 10 peptide starting at 20 μM. (pep86=HiBiT, pep289=VS HiBiT, pep691=HiBiT RR, pep692=VSHiBiT RR). 90 μl of each dilution series was transferred to a white assay plate and then 10 μl of the 1p M stock of LgTrip 3546 added. The plate was placed on an orbital shaker set to 600RPM for 30 minutes. Detection reagent of OptiMEM+10% FBS consisting of 10 mM DTT and 50 uM Furimazine was prepared, and 11 μl added to the samples. The plate was placed on orbital shaker and mixed for 5 minutes at room temperature. The plate was read on a GloMax® Multi+luminometer. Kd and Bmax were calculated using GraphPad Prism one site specific binding.

Figure 189:
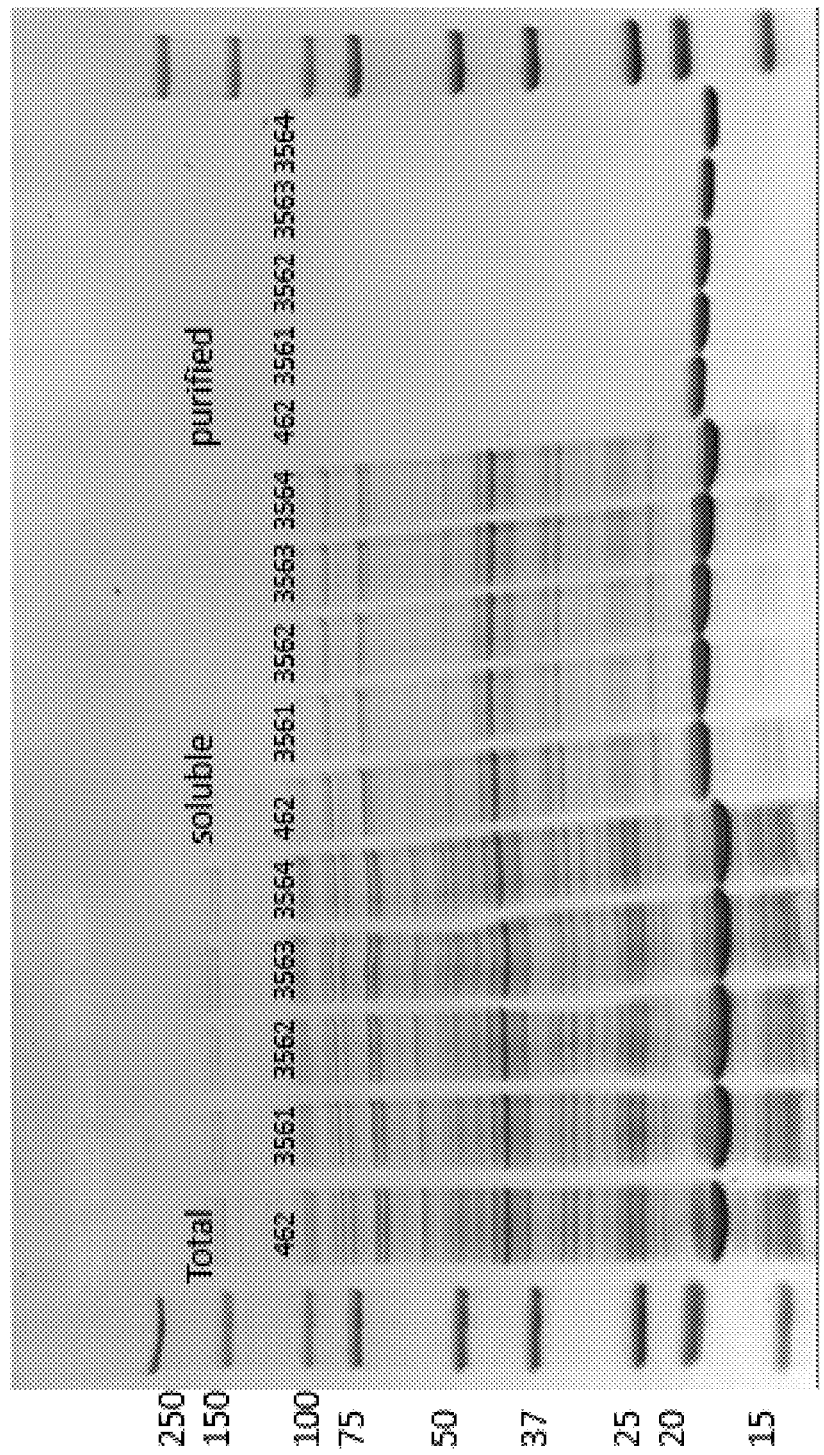

FIG. 189. Purification of Proteins. Cultures for each sample were started from an isolated colony in LB+30 ug/ml KAN and grown for 20 hours at 37° C. Cultures were diluted 1:100 (500 ul in 50 ml) of LB supplemented with 30 ug/ml KAN, 0.1% Rhamnose, and 0.15% glucose. Cultures were grown for 20 hours at 25° C. Cells were spun and resuspended in 9 ml 100 mM HEPES pH 7.5+1 ml FastBreak Lysis Buffer+200 ul RQ DNAse I and placed on orbital mixer for 30 minutes at 4° C. (An aliquot of the total lysate was saved). Each sample was spun (7000RPM 15 minutes) to clear lysate, and MagneHis™ purification system (Promega V8550) used to purify proteins. 1 ml of MagneHis™ magnetic resin was added to each cleared lysate and placed on orbital mixer for 10 minutes. Each sample was washed three times with wash buffer and then 500 ul of elution buffer was used 2 times to recover samples. The samples were dialyzed into 1× TBS using 10,000 MWCO dialysis units (Thermo 88404) for 2 hours.

Figure 190:
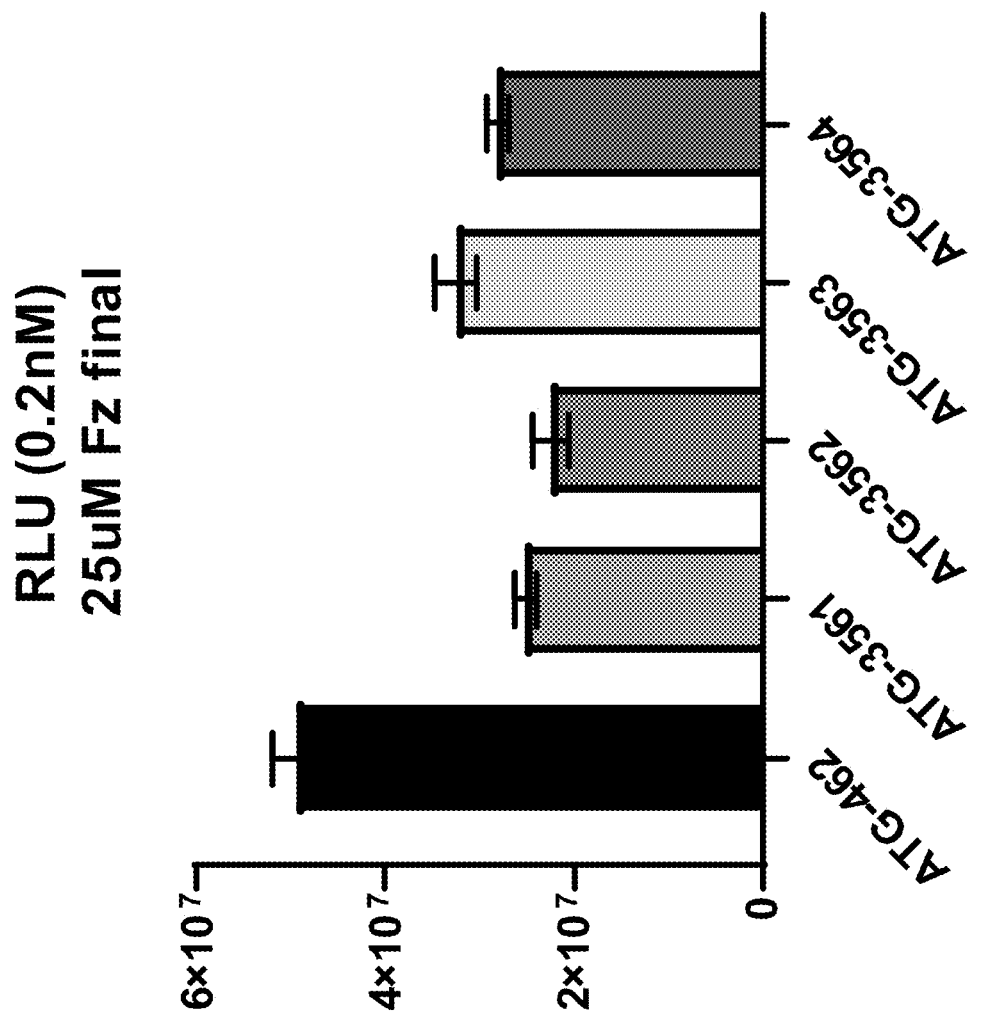

FIG. 190. Luminescence comparison of NanoLuc® (ATG-462) with monomeric LgBiT-SmBiT proteins. Purified protein was diluted to 0.2 nM in TBS+0.01% BSA. 50 ul of each sample was combined with 50 ul of 50 uM Fz in Nano-Glo® buffer (N113, N112), and luminescence measured on GMM+luminometer three minutes after substrate addition.

Figure 191:
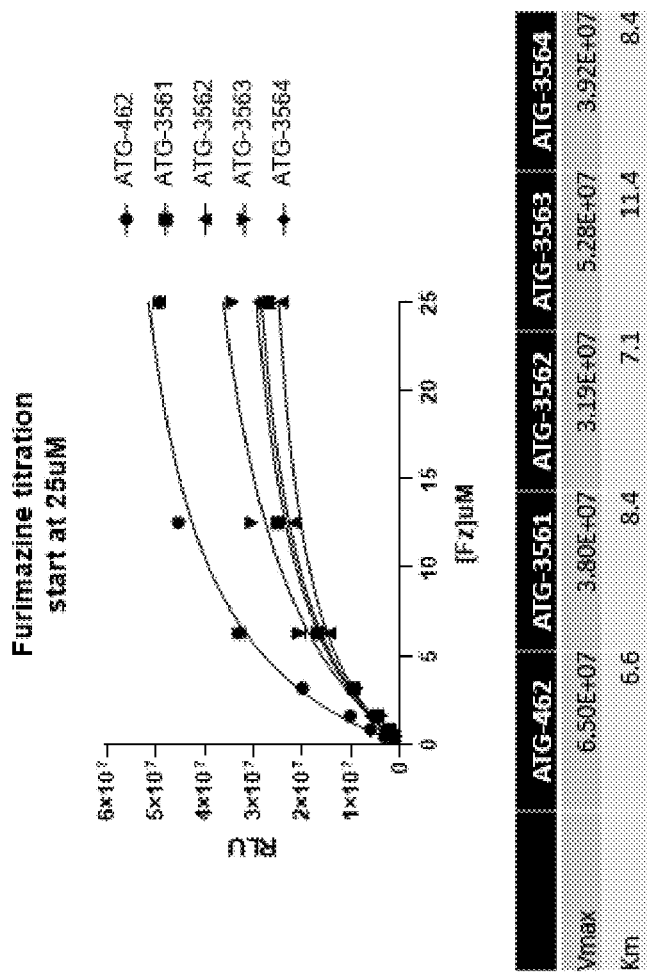

NanoLuc® was ~2× brighter compared to monomeric constructs FIG. 191. Km determination. Purified protein was diluted to 0.2 nM in TBS+0.01% BSA. A 2-fold dilution series of Fz in Nano-Glo® buffer starting at 50 uM (40 ul in 2 ml) was prepared, then 1 ml to 1 ml dilutions. 50 ul of each sample in duplicate was combined with 50 ul of the titration series, incubated for three minutes at RT, and then luminescence read on GMM+

FIGS. 192A-C. Stability of monomeric LgBiT-SmBiT protein compared to NanoLuc® (ATG-462). Each sample was diluted to 2 nM in TBS+0.01% BSA, aliquoted into multiple wells of a 96-well PCR plate, and placed in a thermocycler set for 30 minutes with temperature gradient. After a 30-minute incubation, 5 ul of each sample was combined with 45 ul of TBS+0.01% BSA, 50 ul of Fz diluted into Nano-Glo® buffer added, incubated for 3 minutes, and luminescence measured on a GMM+luminometer. Temperature gradient A: 54°, 57°, 60°, 63°, 66°, and 70° C. Temperature gradient B: 55°, 60°, 65°, 70°, 75°, and 80° C. Temperature gradient C: 65°, 70°, 75°, 80°, 85°, and 90° C.

Figure 193:
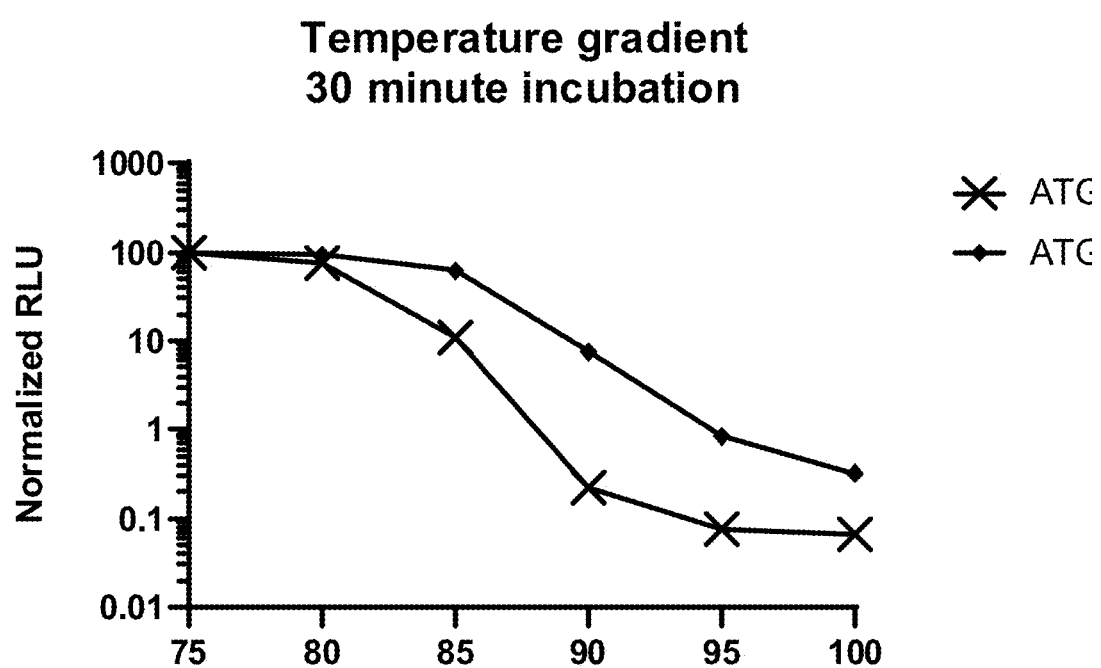

FIG. 193. Thermostability comparison. Each sample was diluted to 2 nM in TBS+0.01% BSA, aliquoted into multiple wells of two-96-well PCR plate and placed in thermocyclers set for 30 minutes with temperature gradient. (75°, 80°, 85°, 90°, 95°, and 100° C.). After a 30-minute incubation, 5 ul of each sample was combined with 45 ul of TBS+0.01% BSA, 50 ul of Fz diluted into Nano-Glo® buffer added, incubated for 3 minutes, and luminescence read a GMM+luminomether. Position 159G provides enhanced stability compared to 159S.

Figure 194:
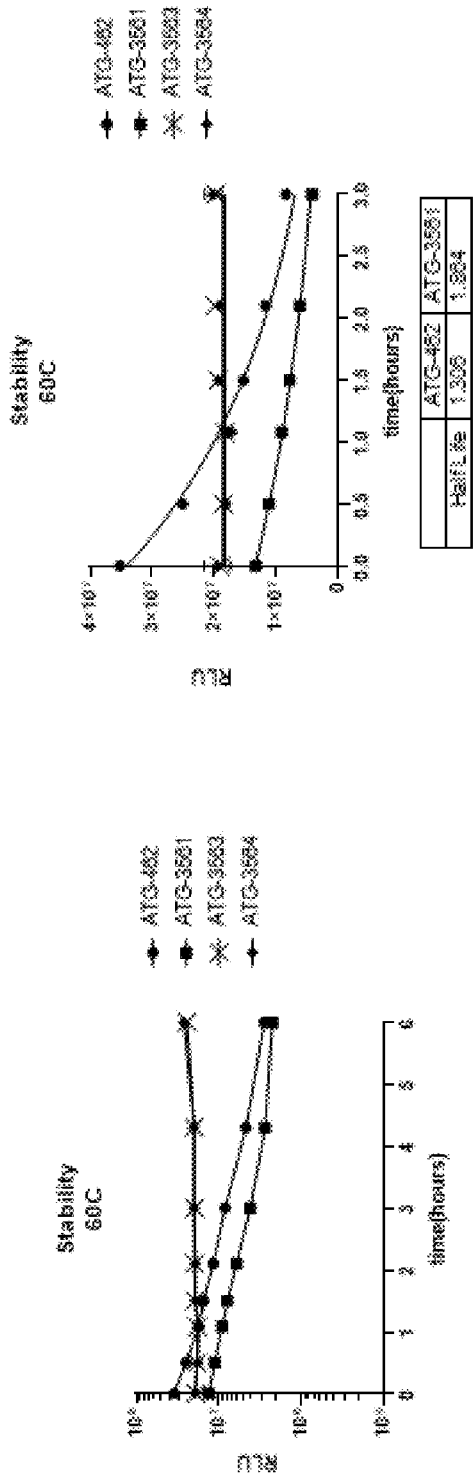

FIG. 194. Stability comparison of LgBiT-SmBiT variants with NanoLuc®. Samples were diluted to 2 nM, aliquoted into wells of a 96-well PCR plate, and placed in a thermocycler set to 60° C. At various timepoints, an aliquot was removed and placed on ice. After all samples were incubated, samples were allowed to equilibrate to RT, and 5 ul of each sample combined with 45 ul of TBS+0.01% BSA. 50 ul of Nano-Glo® buffer+50 uM Fz was added, the plated incubated 3 minutes, and then luminescence measure on GMM+luminometer. The 60° C. stability curve is consistent with temperature gradients curves with LgBiT-SmBiT slightly more stable compared to NanoLuc®, and LgBiT-HiBiT significantly more stable compared to NanoLuc®.

Figure 195:
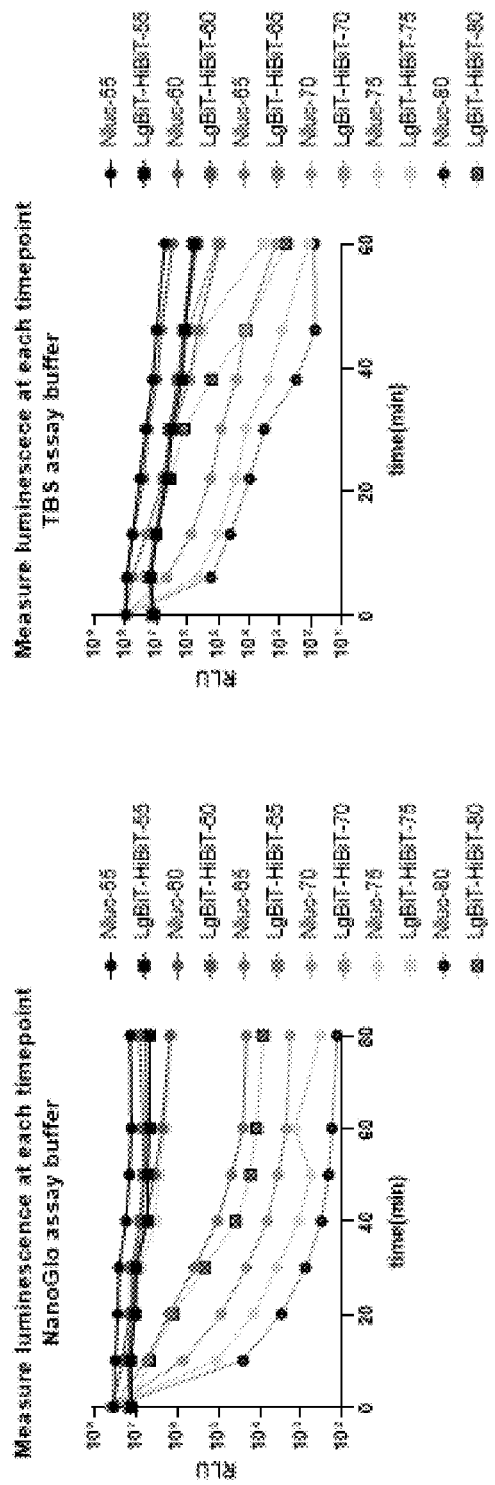

FIG. 195. Stability of monomeric LgBiT-SmBiT at elevated temperature. Samples were diluted to 200 nM in TBS+0.01% BSA and then further diluted to 0.2 nM (4 ul in 4 ml). 50 ul of ATG-462 or ATG-3564 was combined with 50 ul of Nano-Glo® buffer+50 uM Fz or 50 ul of TBS+0.01% BSA+20 uM Fz in wells of a thin wall PCR tray, and the tray placed in a Veritas thermocycler set with gradient 55°, 60°, 65°, 70°, 75°, and 80° C. At various timepoints, samples were removed, and luminescence measure on GMM+luminometer.

Figure 196:
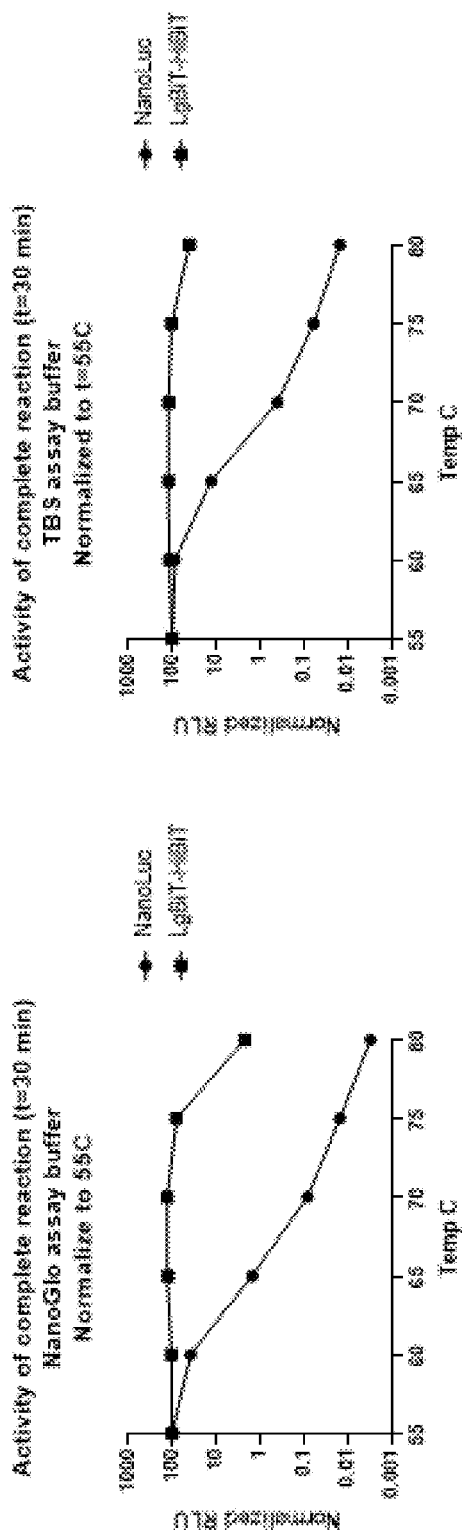

FIG. 196. Stability of monomeric LgBiT-SmBiT at elevated temperature for 30 minutes. Samples were diluted to 200 nM in TBS+0.01% BSA and then further diluted to 0.2 nM (4 ul in 4 ml). 50 ul of ATG-462 or ATG-3564 was combined with 50 ul of Nano-Glo® buffer+50 uM Fz or 50 ul of TBS+0.01% BSA+20 uM Fz into wells of a thin wall PCR tray, and the tray placed in a Veritas thermocycler set with gradient 55°, 60°, 65°, 70°, 75°, and 80° C. Luminescence was measure at 30 minutes.

Figure 197:
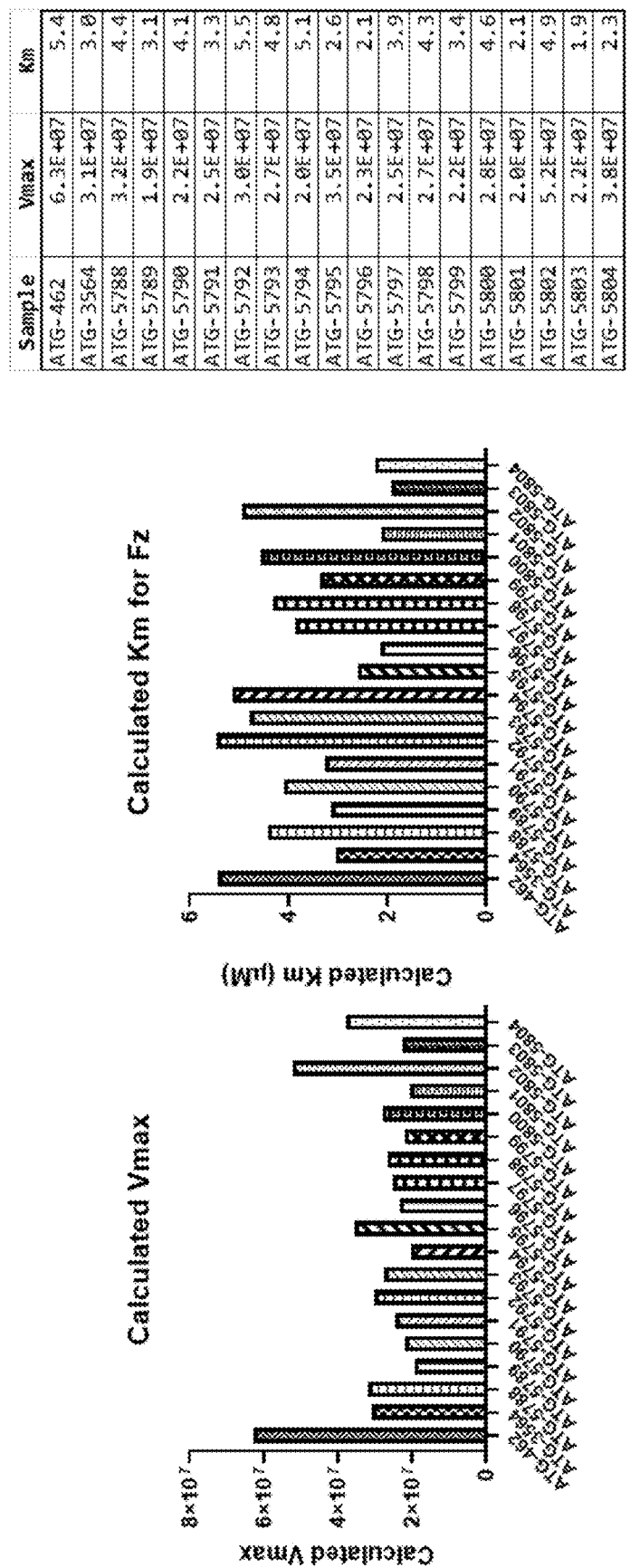

FIG. 197. Measurement of Km and Vmax for purified NanoLuc® mutants. Purified protein was diluted to 0.2 nM in TBS+0.01% BSA. A 2-fold dilution series of Fz in Nano-Glo® buffer starting at 50 uM (40 ul in 2 ml), then 1 ml to 1 ml dilutions. 50 ul of each sample in duplicate was combined with 50 ul of the titration series, incubated for three minutes at RT, and luminescence read on GMM+luminometer.

Figure 198:
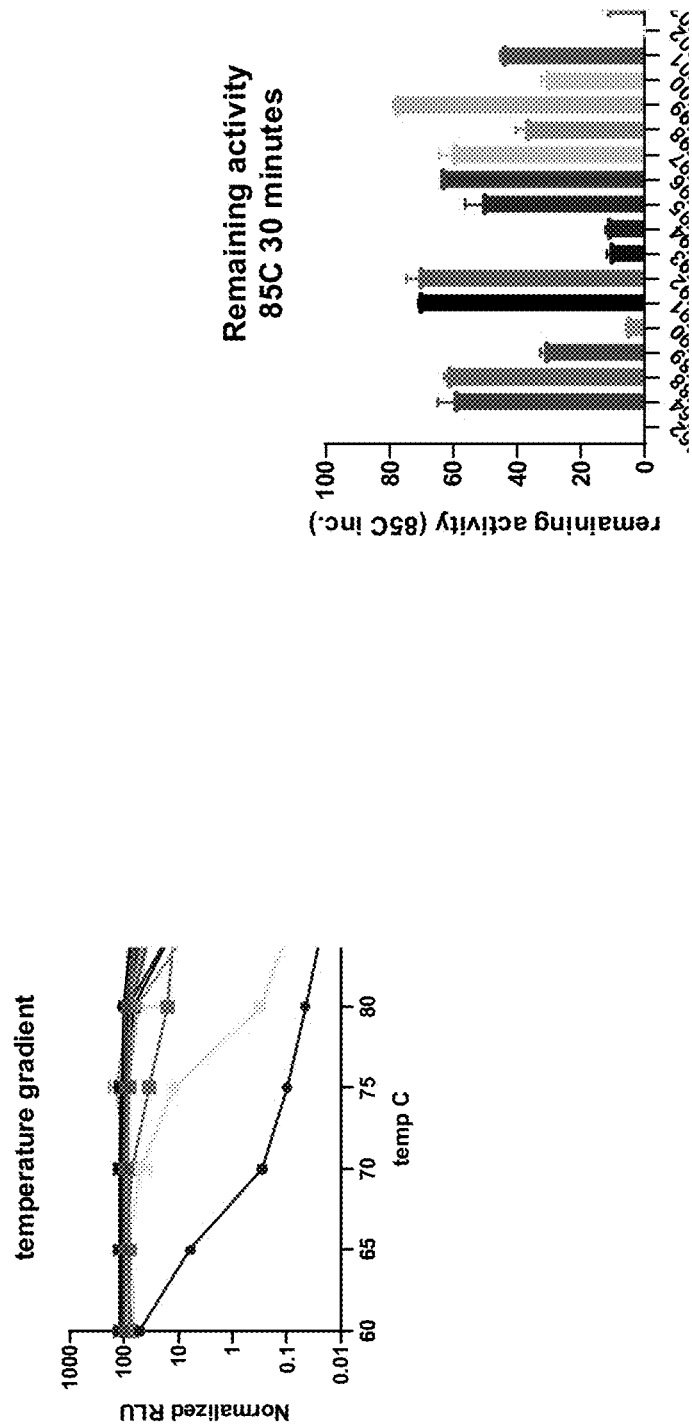

FIG. 198. Thermal challenge.

Figure 199:
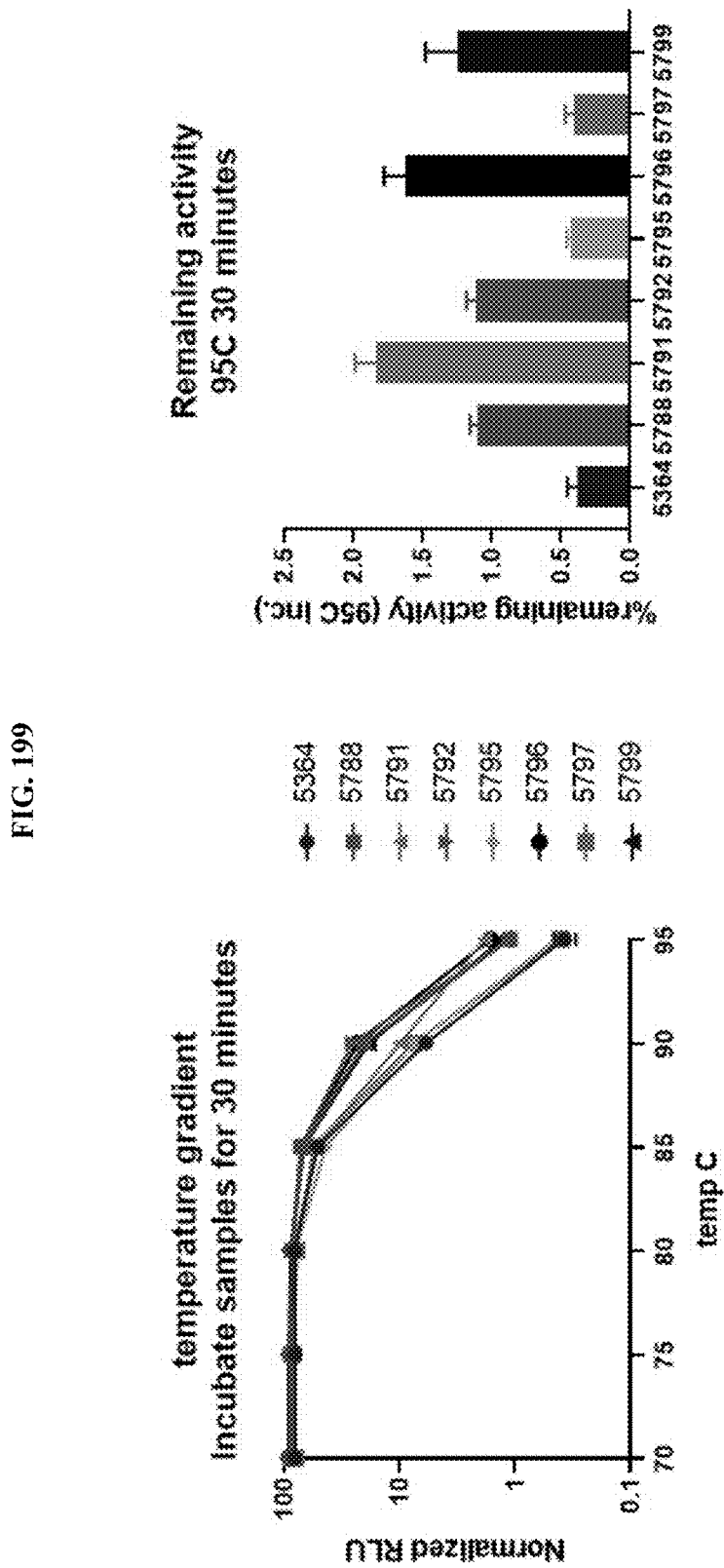

FIG. 199. Thermal challenge with stable variants. Each sample was diluted to 2 nM in TBS+0.01% BSA, aliquoted into multiple wells of two-96-well PCR plates, and placed in a thermocyclers set for 30 minutes with temperature gradient. (70°, 75°, 80°, 85°, 90°, and 95° C.). After 30-minute incubation, 5 ul of each sample was combined with 45 ul of TBS+0.01% BSA, 50 ul of Fz diluted into Nano-Glo® buffer added, incubated for 3 minutes, and luminescence measured on a GMM+luminometer.

Figure 200:
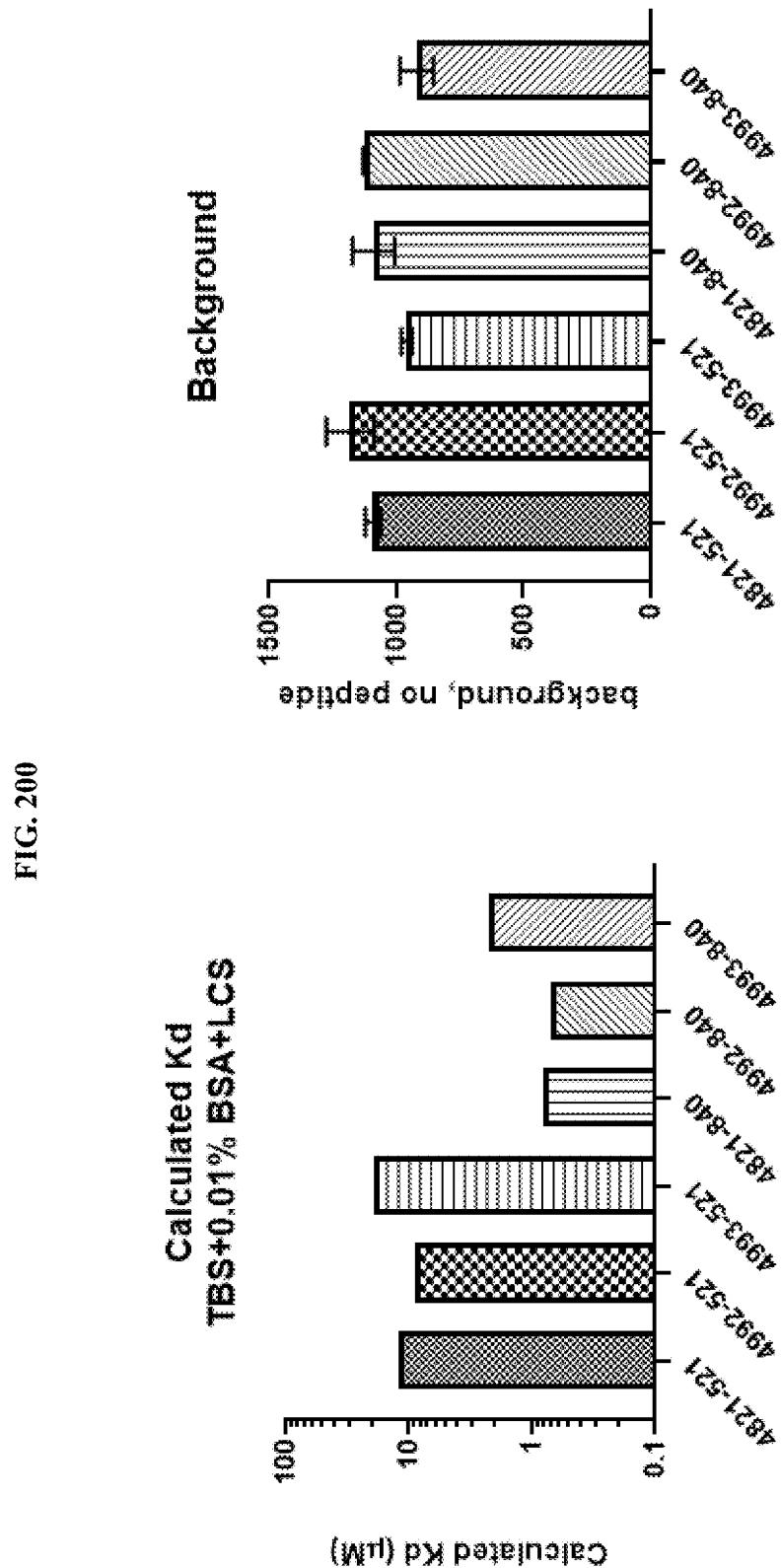

FIG. 200. Comparison of pep521 and pep 40 with detector proteins. Each protein was diluted to 20 nM in TBS+0.01% BSA. A 3× dilution series of pep521 and pep840 was prepared in TBS+0.01% BSA starting at 20 uM. 50 ul of each enzyme dilution in duplicate was combined with 50 ul of each peptide titration and incubated for 10 minutes on shaker for pre-equilibration. An assay buffer was prepared by diluting Nano-Glo Live Cell Substrate (LCS; Promega N205) 30-fold into TBS+0.01% BSA, 100 ul added to each well, incubated 5 minutes, and luminescence measured on GMM+luminometer. The background reading was obtained from samples that contained no peptide.

FIG. 201. Comparison of strand 9 detector proteins with pep840. Each protein was diluted to 200 nM in TBS+0.01% BSA. A 3× dilution series of pep840 was prepared in TBS +0.01% BSA starting at 0.5 uM. 50 ul of each enzyme dilution in quadruplicate was combined with 50 ul of each peptide titration and incubated for 10 minutes on shaker for pre-equilibration. An assay buffer was prepared by diluting Nano-Glo LCS (Promega N205) 30-fold into TBS+0.01% BSA, 100 ul added to each well, incubated 5 minutes, and luminescence measured on GMM+luminometer. The background reading was obtained from samples that contained no peptide.

Figure 202:
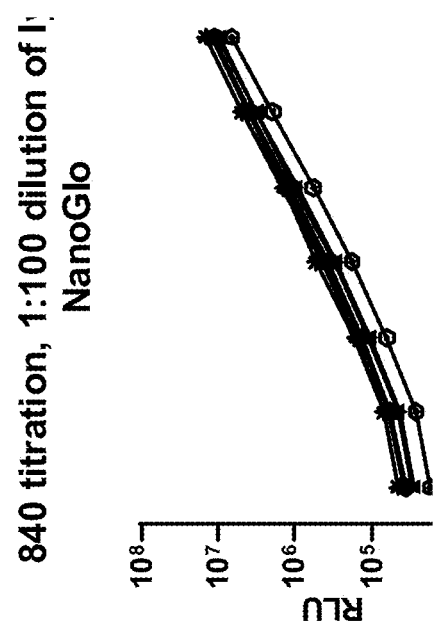

FIG. 202. Test linker series. Overnight cultures of each sample were prepared in LB +100 ug/ml amp. The following day, cultures were diluted 1:20 (150 ul to 3 ml) in LB+0.1% Rhamnose+100 ug/ml amp, grown for 4 hours at 37° C., and then lysed with PLB lysis buffer (0.3× Passive Lysis Buffere (Promega)+25 mM HEPES pH 7.5) (500 ul of lysate to 4.5 ml of PLB lysis buffer). To assay, lysates were diluted 1:100 into TBS+0.01% BSA. A 3× dilution series of strand 9 (pep840) starting at 10 nM was prepared, 50 ul combined with 50 ul of the diluted lysate for each sample, and incubated for 20 minutes at RT on orbital shaker set to 600 rpm. 100 ul of NanoGlo® buffer+50 uM Furimazine (N113) was added, and luminescence measured on GMM+luminometer. Each clone, with the exception of ATG-5485, 5AA linker, produced similar RLU values to ATG-4992.

Figure 203:
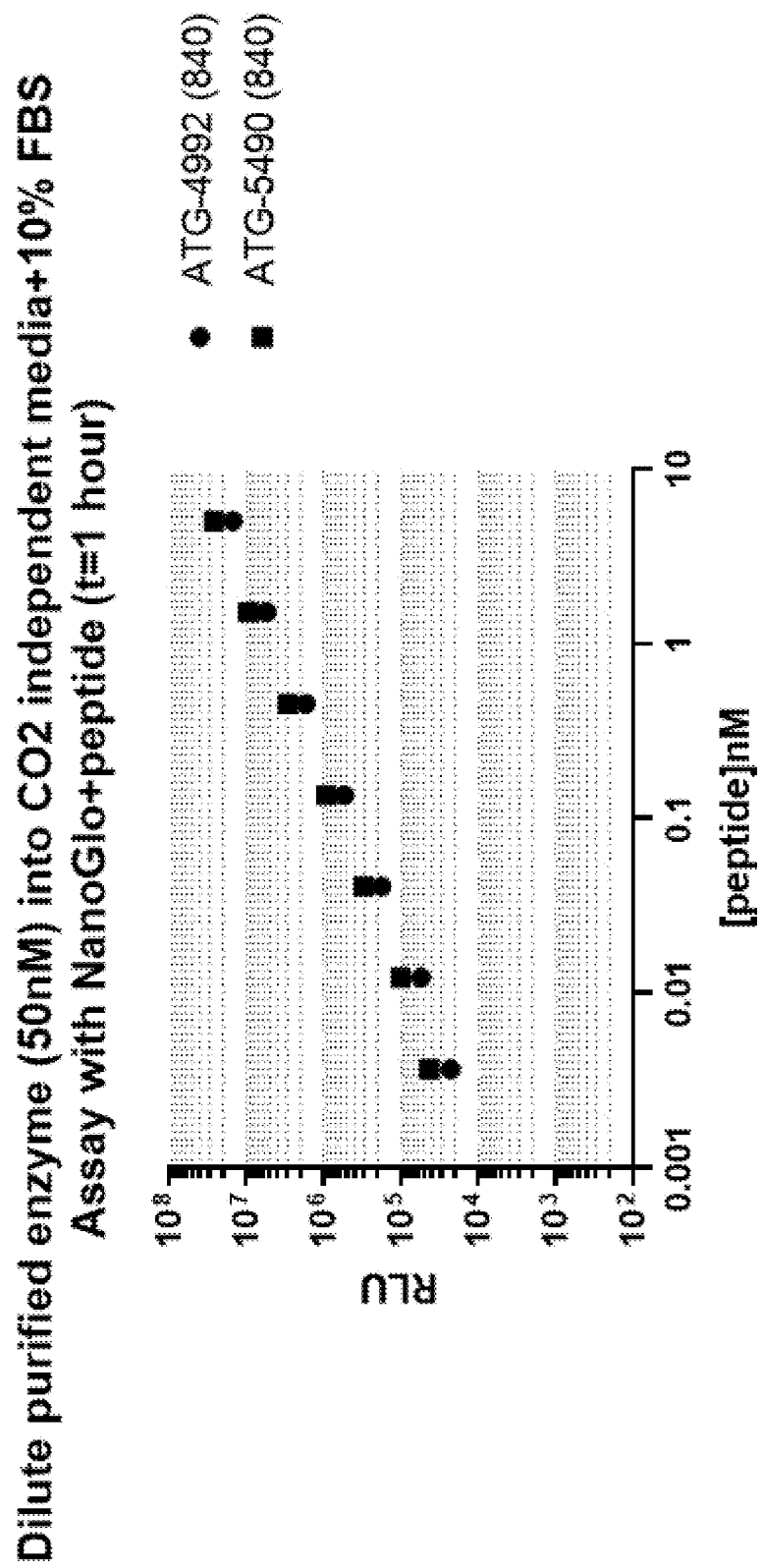

FIG. 203. Linker comparison: 8GS (ATG-4992) vs. 11GS (ATG-5490). ATG-4992 and ATG-5490 were purified using the MagneHis™ purification system and diluted to 100 nM in $CO_2$ independent media+10% FBS. A 3-fold serial dilution of pept840 was prepared starting at 10 nM in Nano-Glo® buffer+50 uM furimazine. 50 ul of each enzyme dilution was combined in quadruplicate with 50 ul the peptide titration. Luminescence was measured over time in a GMM+luminometer. The data plotted is from the 50-minute kinetic read. ATG-5490 had a ~2-fold higher signal compared to ATG-4992 FIG. 204. Kd of mutants of ATG-4992 and ATG-5490. Overnight cultures of each sample in LB+100 ug/ml amp were prepared. The following day, cultures were diluted 1:20 (150 ul to 3 ml) in LB+0.1% Rhamnose+100 ug/ml amp, grown for 4 hours at 37° C., and lysed with PLB lysis buffer (500 ul of lysate to 4.5 ml of PLB lysis buffer). To assay, lysates were diluted 1:100 into TBS+0.01% BSA. A 3× dilution series of strand 9 (pep840) was prepared starting at 40 uM, 50 ul combined with 50 ul of the diluted lysate for each sample, and incubated for 20 minutes at RT on orbital shaker set to 600 rpm. 100 ul of Nano-Glo® buffer+50 uM Furimazine (N113), and luminescence measured on GMM+luminometer.

Figure 205:
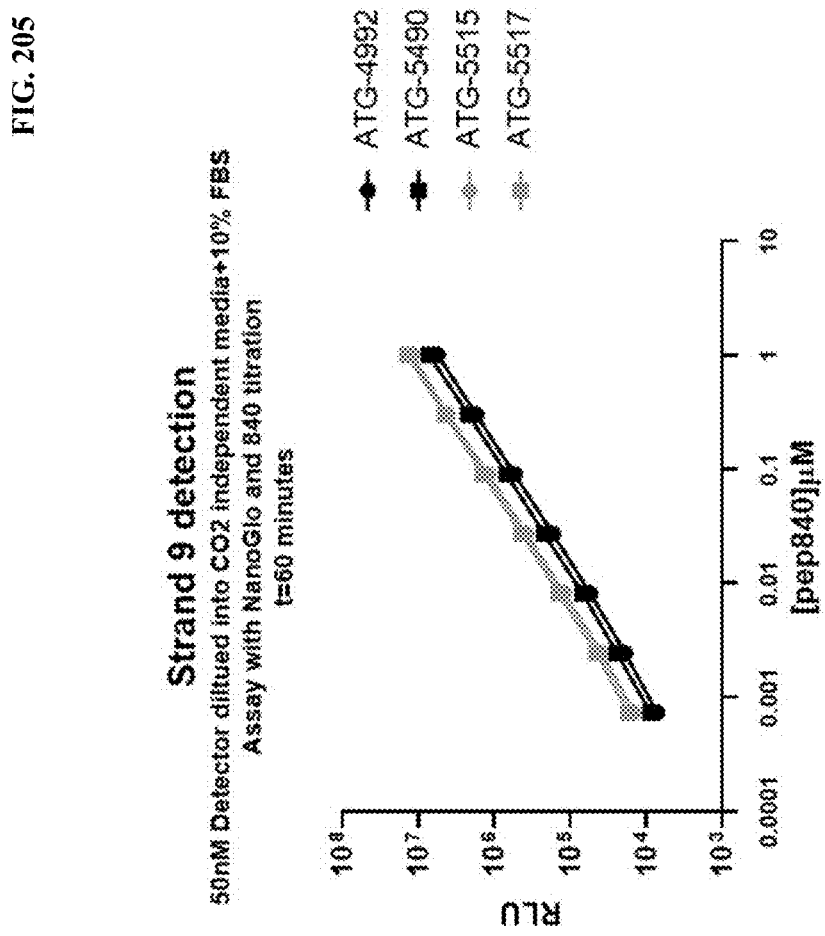
Figure 206:
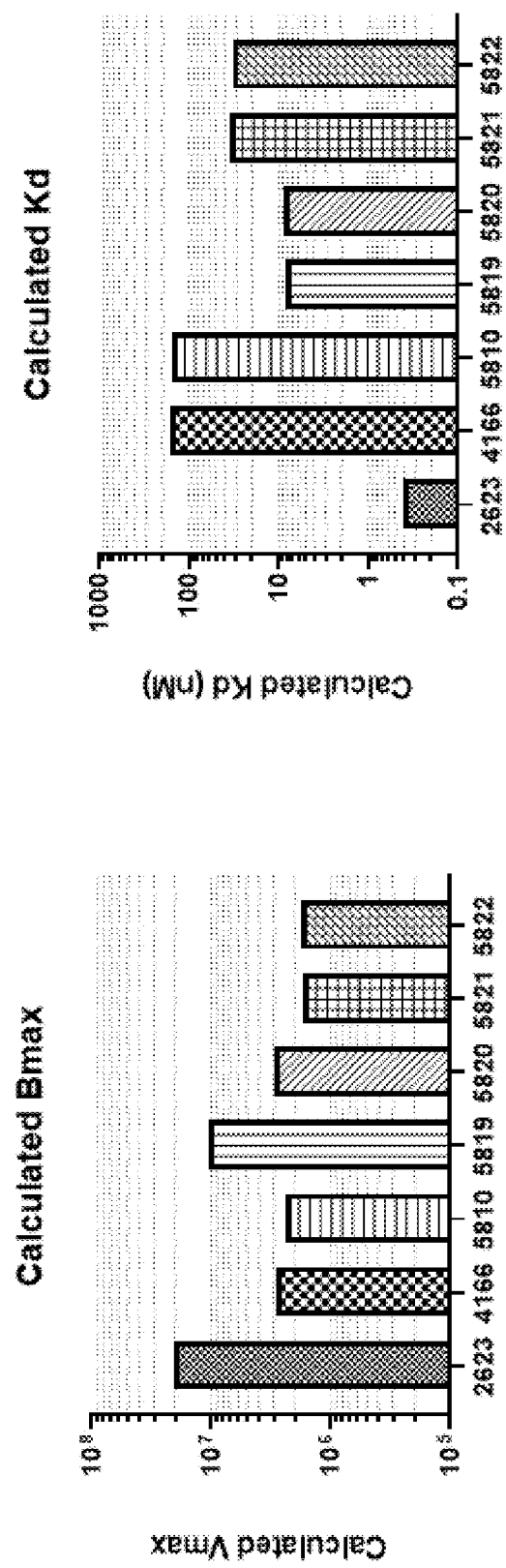

FIG. 205. Comparison of mutants of ATG-4992 and ATG-5490. Proteins were purified (MagneHis™ Purification System, Promega) and diluted to 100 nM in $CO_2$ independent media+10% FBS. A 3-fold dilution series was prepared with pep840 starting at 2 nM in Nano-Glo® buffer+50 uM furimazine. 50 ul of each enzyme dilution was combined in triplicate with 50 ul of each peptide titration in the Furimazine/NanoGlo solution. Luminescence was measured every 5 minutes. Data is plotted from the 60-minute timepoint. Clones ATG-5515 and ATG-5517 had lower calculated Kd values and showed higher RLU values when paired with pep840 and slightly higher signal to background FIG. 206. Biochemical analysis. Samples were purified using MagneHis™ Protein Purification System (Promega V8500) and diluted to 0.2 nM in TBS+0.01% BSA. A 3× dilution series of VS-HiBiT peptide (pep289) was prepared in TBS+0.01% Tergitol. One series was prepared starting at 400 nM and the other at 20 uM. 50 ul of each diluted enzyme (0.2 nM) was combined with 50 ul of each peptide titration and incubated on shaker for 10 minutes. 100 ul of Fz, diluted 250-fold in TBS+0.01% BSA was added, the plate placed on shaker for 5 minutes, and luminescence measured on a GMM+luminometer. Kd and Bmax was calculated using GraphPad prism one site specific binding regression.

Figure 207:
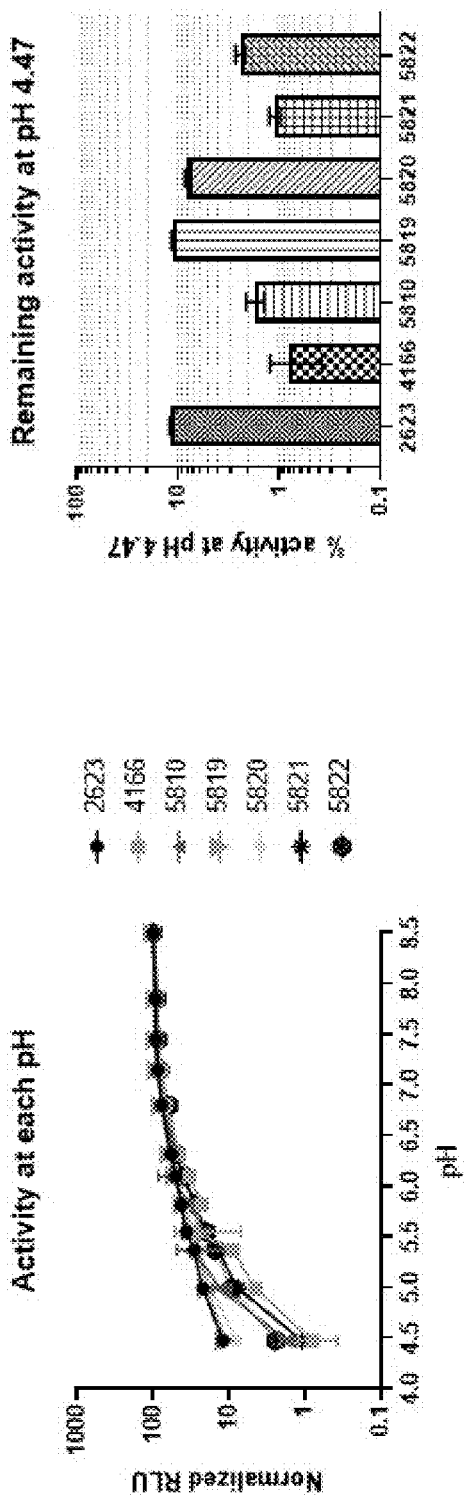

FIG. 207. Activity at various pH. Each sample of purified enzyme was diluted to 0.2 nM in TBS+0.01% BSA, 20 uM VS HiBiT (pep289) was added to each solution, and incubated at RT for 20 minutes. 990 ul of each pH buffer was aliquoted into wells of a deep well plate, 10 ul of furimazine (Promega, N113) added, and 50 ul of each enzyme/peptide dilution with 50 ul of the pH buffer/furimazine solution added. Samples were incubated for 12 minutes at RT, and luminescence measured on GMM+luminometer. Data was normalized to the pH 8.49 sample.

Figure 208:
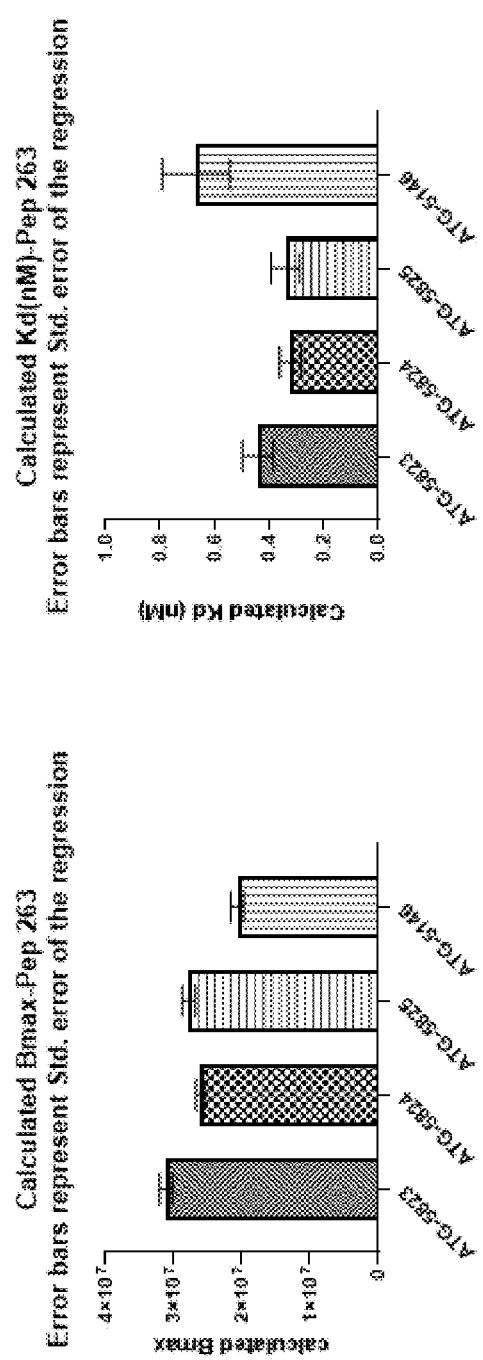

FIG. 208. Biochemical comparison of ATG-5823, ATG-5824, ATG-5825, and ATG-5146 (pep 263). Proteins (ATG-5823, ATG-5824, and ATG-5825) were purified using MageHis™ purification system (Promega). ATG-5146 was purified using an AKTA with Nickel Sepharose column. Purified proteins were diluted first to 200 nM in TBS+0.01% BSA and then further diluted to 0.2 nM in TBS+0.01% BSA. A three-fold dilution series of pep263 was prepared starting at 100 nM in TBS+0.01% BSA+0.02% Tergitol. 50 ul of each enzyme was combined with 50 ul of the peptide dilution series. Samples were incubated on orbital shaker (600RPM) for 10 minutes. After incubation, 100 ul of LCS (N205 Promega) was diluted 1:30 into TBS+0.01% BSA and added to each sample. Samples were incubated for 3 minutes at RT, and then luminescence was measured luminescence was measured on a GloMax® Multi+.

Figure 209:
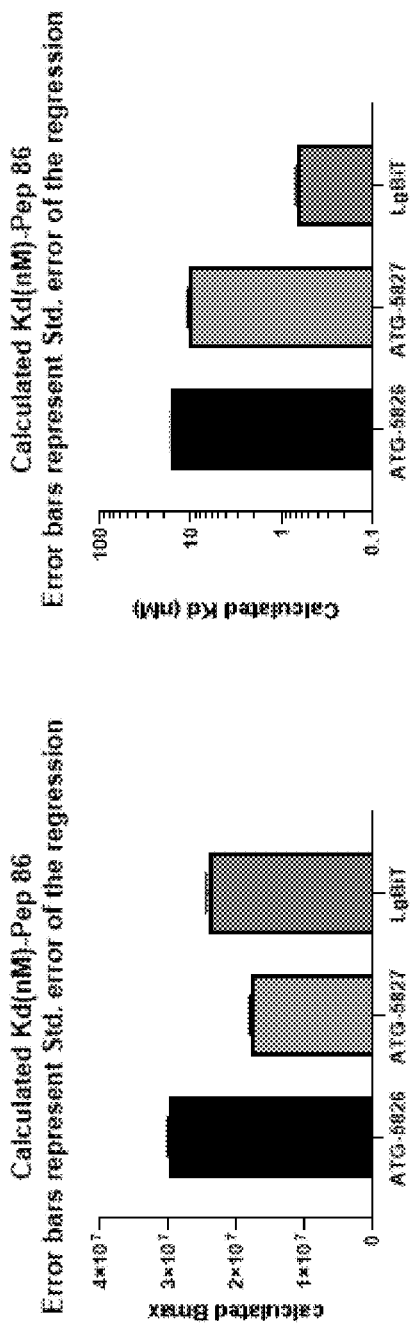

FIG. 209. Biochemical comparison of ATG-5826 and ATG-5827 with pep86. Proteins were purified using MagneHis™ purification system (Promega V8500). Purified proteins were diluted first to 200 nM in TBS+0.01% BSA and then further diluted to 0.2 nM in TBS+0.01% BSA. Two, 2-fold titration series of pep86 were prepared starting at 1 uM and 100 nM in TBS+0.01% BSA+0.02% Tergitol. 50 ul of ATG-5826 and ATG-5827 were combined with 50 ul of the peptide dilution series that started at 1 uM. 50 ul of LgBiT protein (Promega N401C) was combined with the peptide titration series that started at 100 nM. Samples were incubated on orbital shaker (600RPM) for 10 minutes. After incubation, 100 ul of LCS (N205 Promega) was diluted 1:30 into TBS+0.01% BSA and added to each sample. Samples were incubated for 3 minutes at RT, and then luminescence was measured luminescence was measured on a GloMax® Multi+.

Figure 210:
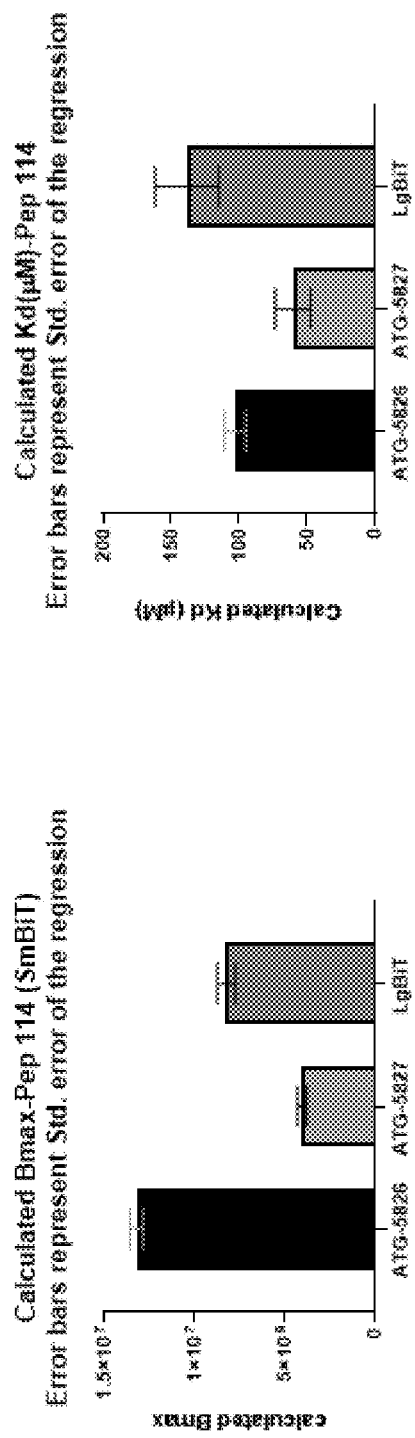

FIG. 210. Biochemical comparison of ATG-5826 and ATG-5827 with pep 114. Proteins were purified using MagneHis™ purification system (Promega V8500). Purified proteins were diluted first to 200 nM in TBS+0.01% BSA and then further diluted to 0.2 nM in TBS+0.01% BSA. Two, 2-fold titration series of pep 114 was prepared starting at 1 mM in TBS+0.01% BSA+0.02% Tergitol. 50 ul of ATG-5826, ATG-5827, and LgBiT protein (Promega N401C) were combined with the peptide titration series. Samples were incubated on orbital shaker (600RPM) for 30 minutes. After incubation, 100 ul of LCS (N205 Promega) was diluted 1:30 into TBS+0.01% BSA and added to each sample. Samples were incubated for 3 minutes at RT, and then luminescence was measured luminescence was measured on a GloMaxMulti+.

Figure 211:
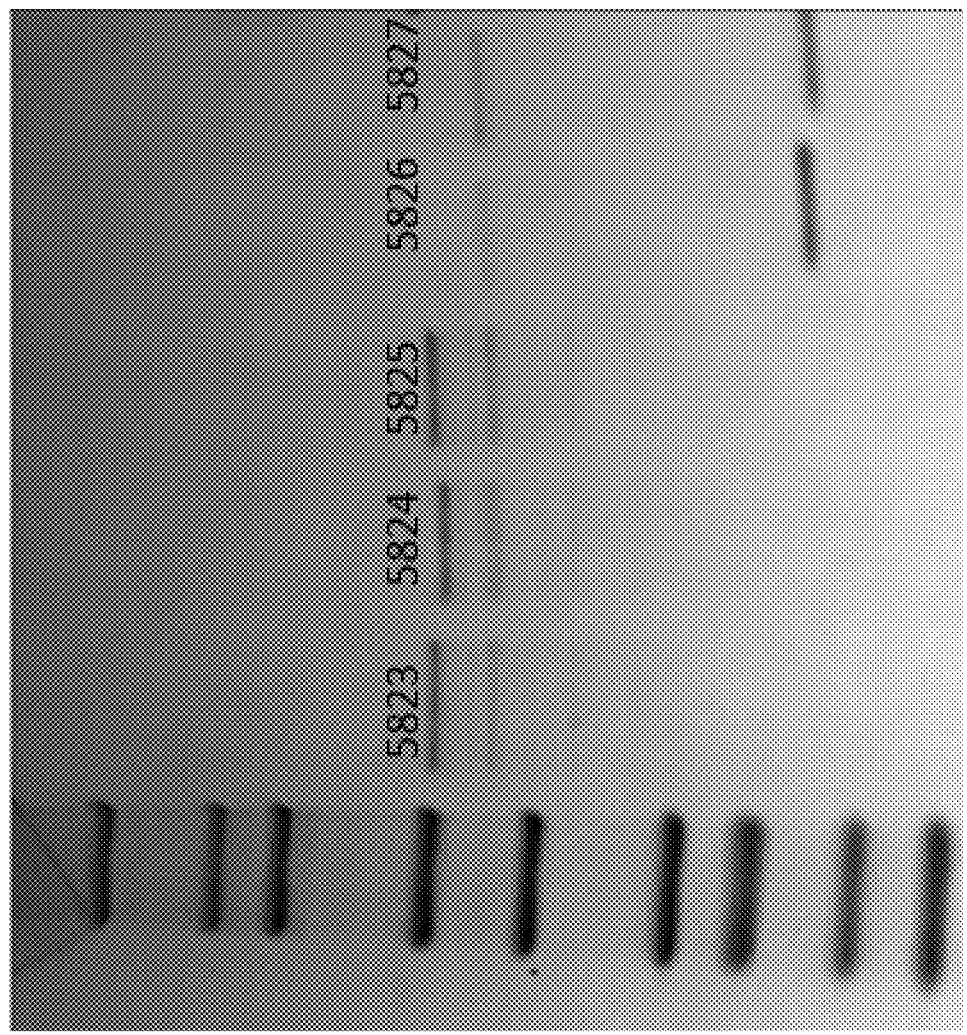

FIG. 211. SDS PAGE analysis. Each protein was diluted to 0.1 ug/ml in TBS+1× SDS loading dye. Samples were heated to 70° C. for 5 minutes and then 3 ul was loaded to an SDS PAGE gel.

Figure 212:
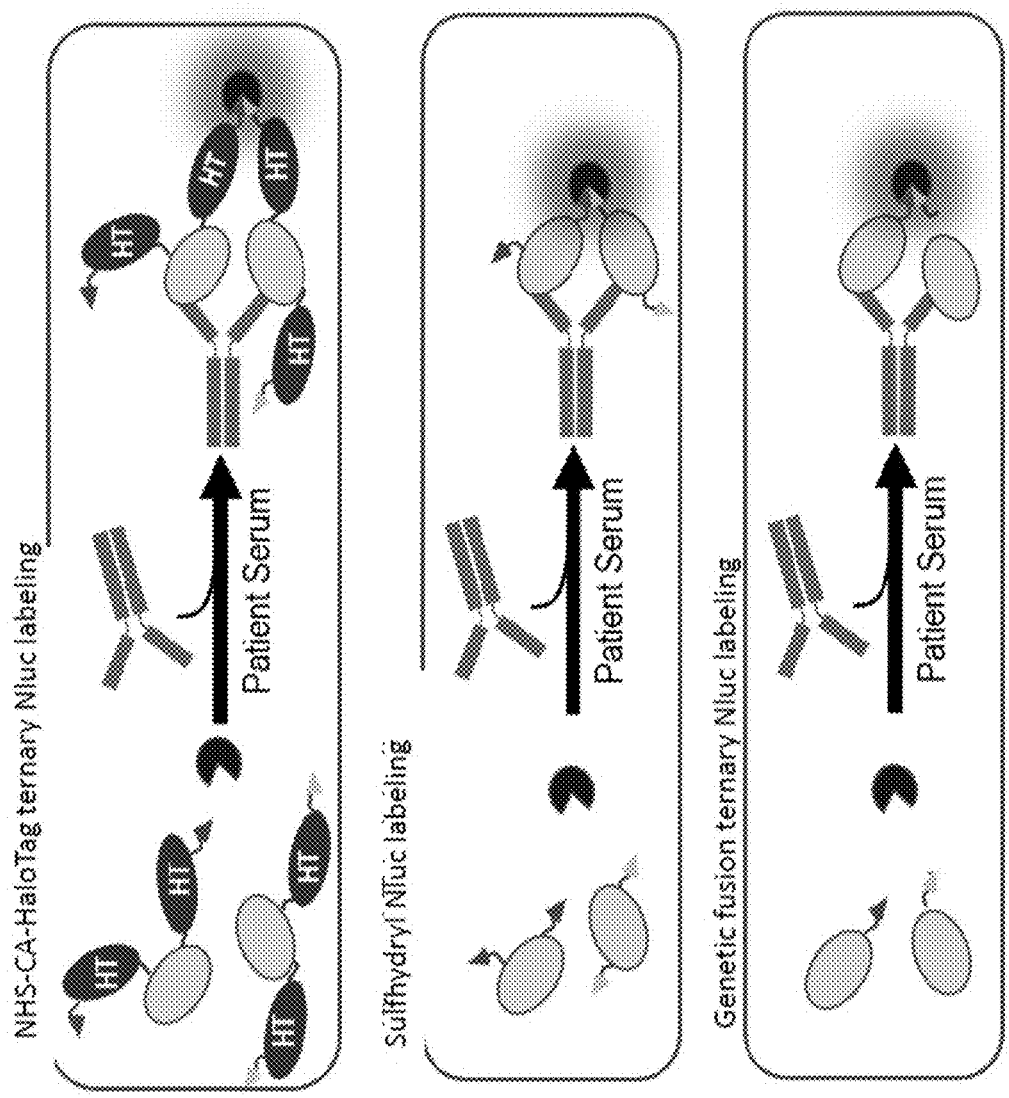

FIG. 212. Exemplary assay formats for the detection of SARS-COV-2.

Figure 213:
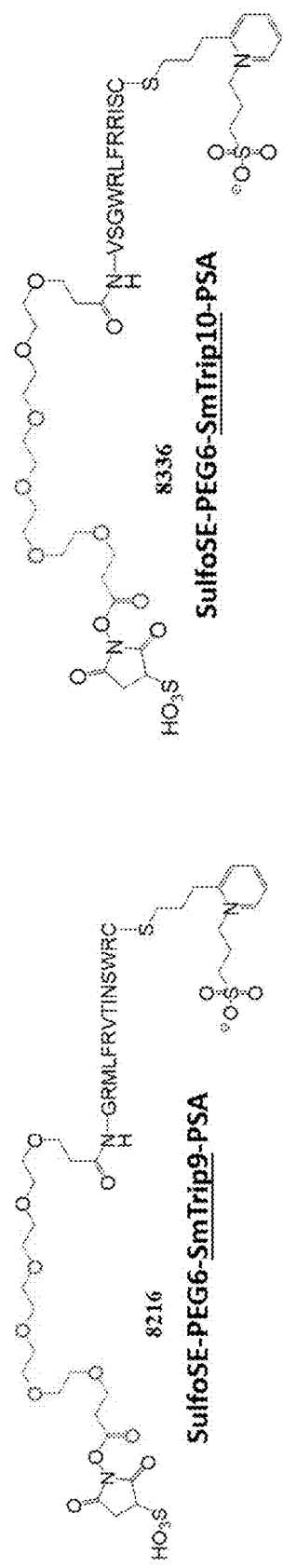

FIG. 213. Exemplary reagents used to screen reactive peptides. SulfoSE reacts with lysines on target proteins, PEG6 linker and pyridinium sulfonic acid (PSA) provide solubility, and PSA has UV signature that can be used to measure labeling density.

Figure 214:
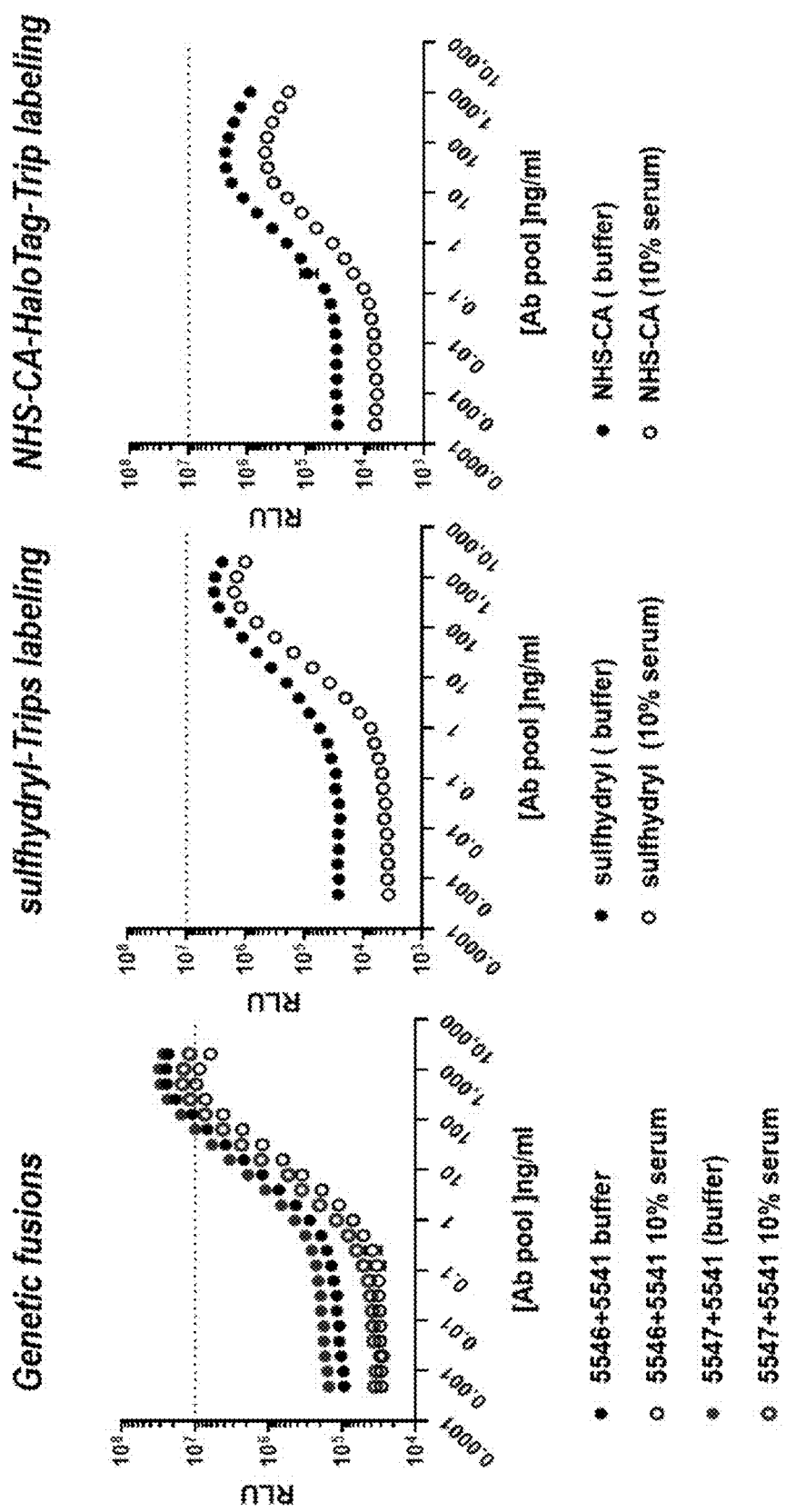

FIG. 214. Spike-in antibody titration of alternative labeling strategies for detection of SARS-COV-2.

FIG. 215. Purified SARS-CoV-2 Nucleocapsid antigen detection.

FIG. 216. Samples tested with the lyophilized antigen assay in handheld assay. Patient nasal swab was placed into reagent tube breaking the foil seal at the bottom of the tube. Buffer containing the reagent cap was placed onto the reagent tube containing sample, which locks. The buffer capsule was cracked to release and then shook. The reagent tube was inserted into a handheld luminometer, and the sample analyzed.

Figure 217:
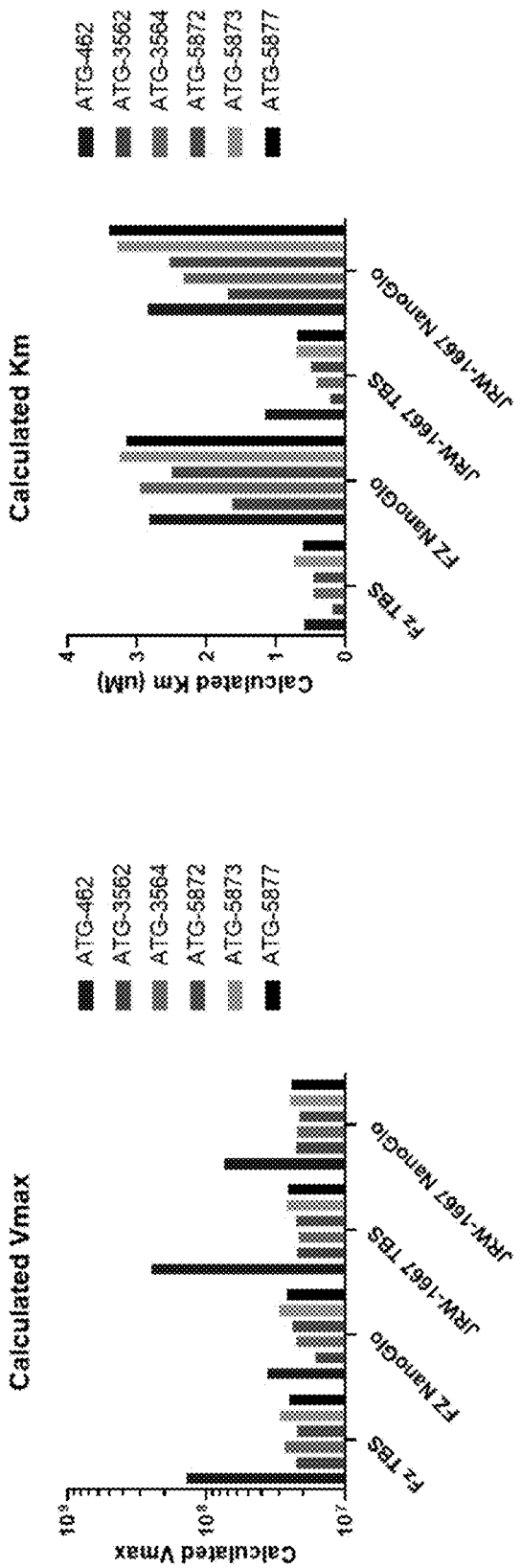

FIG. 217. Monomeric NanoBiT® with Fluoro-Fz. Each enzyme to be tested was diluted into TBS+0.01% BSA. A titration series with either FZ (N205) or JRW-1677 was prepared in either TBS (starting at 20 uM) or NanoGlo (starting at 25 uM). Each substrate was serially diluted with either TBS+0.01% BSA or Nano-Glo® buffer (Promega N112). 50 ul of each enzyme dilution was combined with 50 ul of each substrate titration, incubated for 3 minutes, and then measured luminescence on GMM+luminometer. Kinetic parameters for Fz and JRW-1667 were calculated. NanoLuc® (ATG-462) produced higher RLU values with both Fz and JRW-1667 (~10-20 fold) compared to the Monomeric NanoBiT® constructs when TBS was used to dilute substrates. NanoLuc® and the monomeric constructs showed similar RLU values for Fz/NanoGlo buffer, but only NanoLuc® showed improved luminescence with JRW-1667. Although the monomeric NanoBiT® constructs showed lower RLU values with both Fz and JRW-1667, RLU values were similar for the two buffers and two substrates. Km values are lower in TBS+0.01% BSA compared to NanoGlo®, but generally the Km values were similar for each condition except ATG-3562 (Monomeric LgBiT-SmBiT), which showed a lower calculated Km for all conditions tested.

Figure 218:
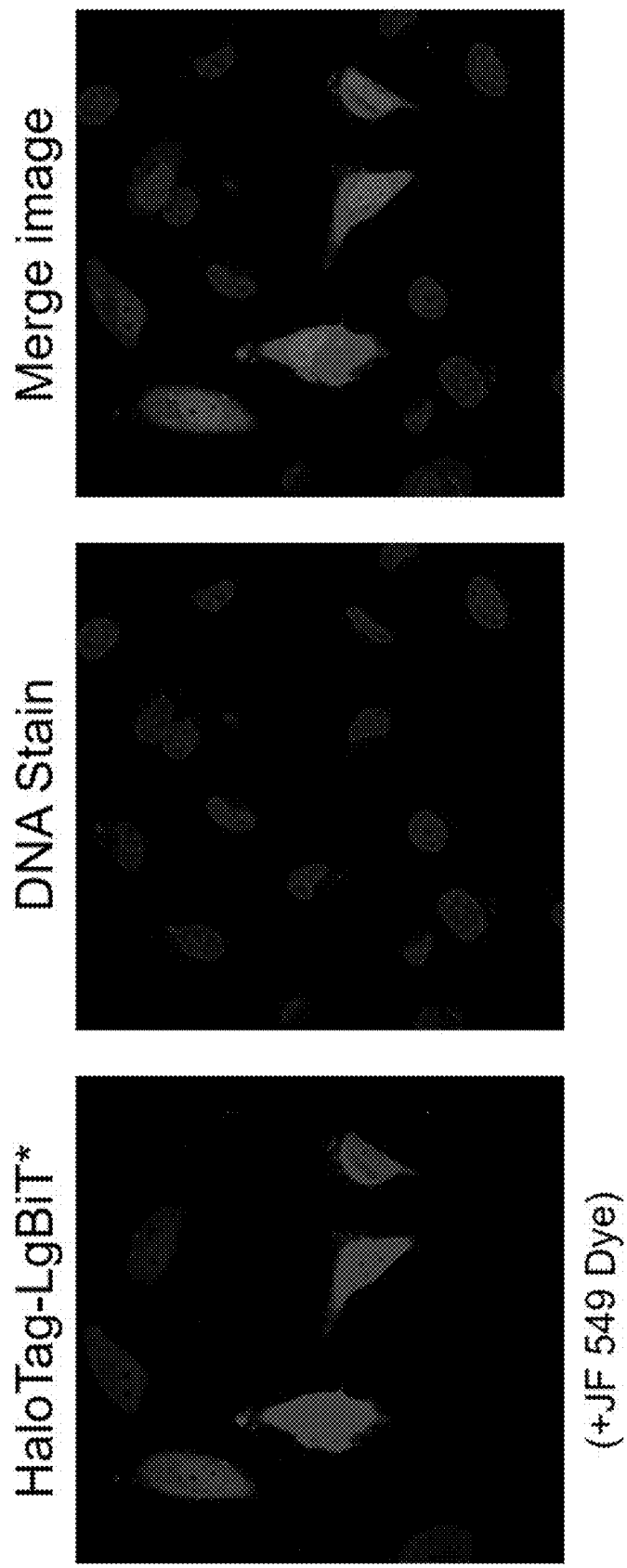

FIG. 218. HaloTag®-LgBiT®—mammalian cell expression and fluorescence imaging. Immunofluoresence images of HaloTag®-LgBiT® in HeLa cells showed its ubiquitous distribution in the cells. Left: red channel only, Middle: blue channel only; Right: overlay.

Figure 219:
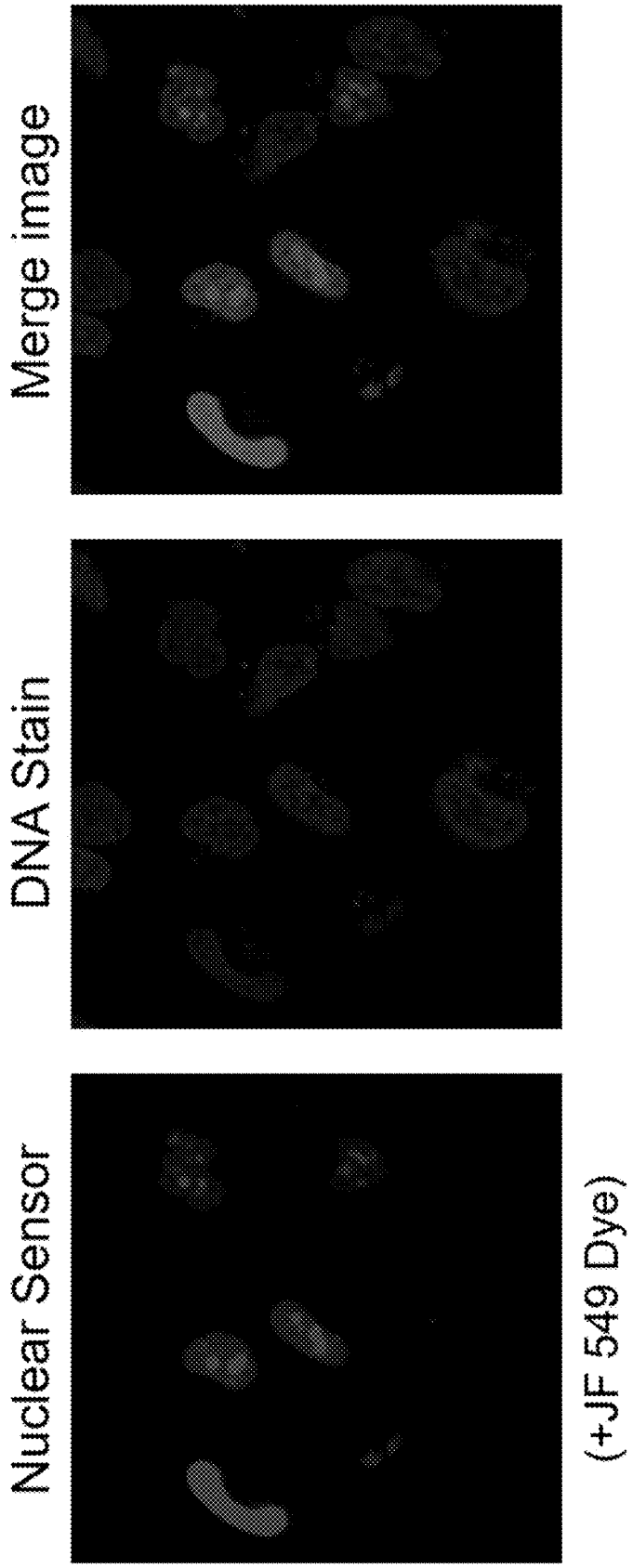

FIG. 219. Nuclear sensor—mammalian cell expression and fluorescence imaging. Immunofluoresence images of nuclear sensor in HeLa cells showed its nuclear localization. Left: red channel only, Middle: blue channel only; Right: overlay.

Figure 220:
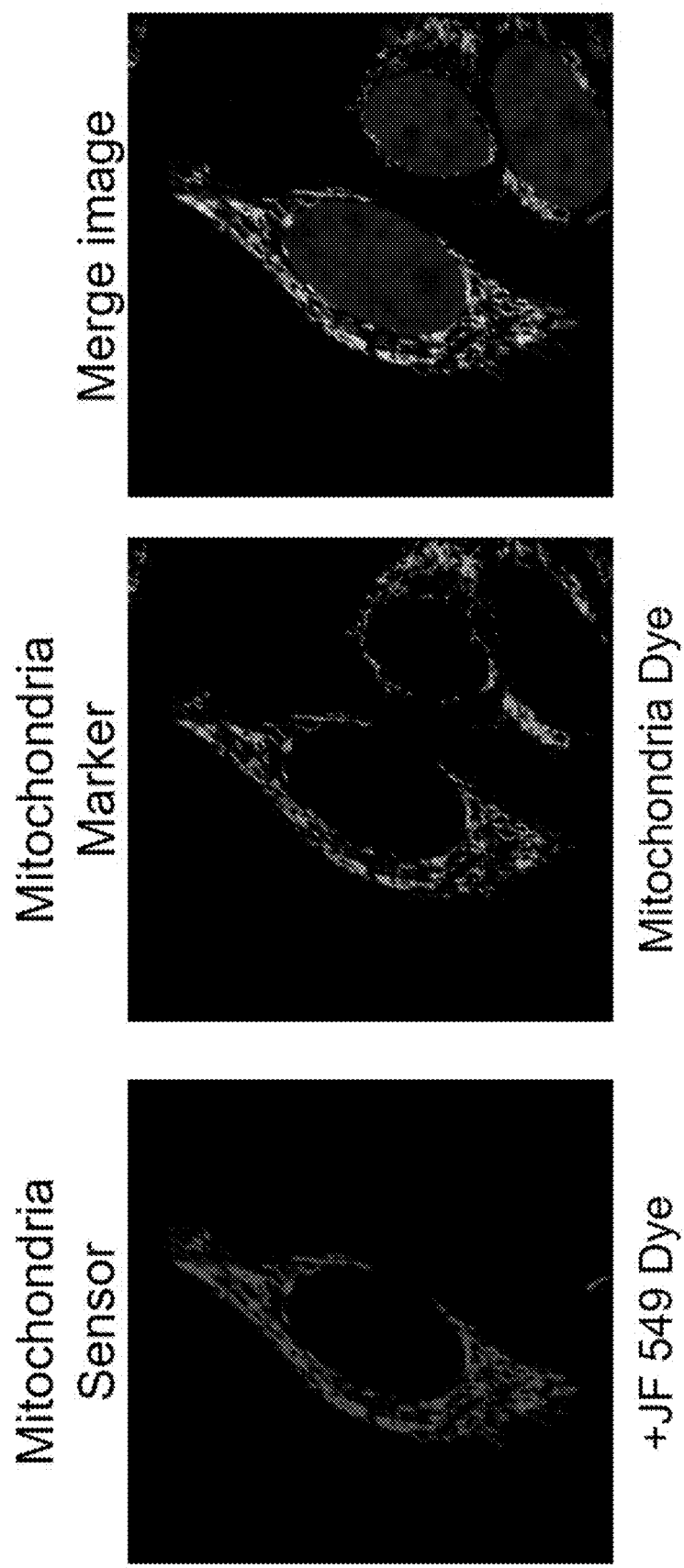

FIG. 220. Mitochondrial sensor—mammalian cell expression and fluorescence imaging. Immunofluoresence images of mitochondria sensor in HeLa cells showed its localization in mitochondria matrix. DNA stain in blue. Left: red channel only, Middle: green channel only; Right: overlay.

Figure 221:
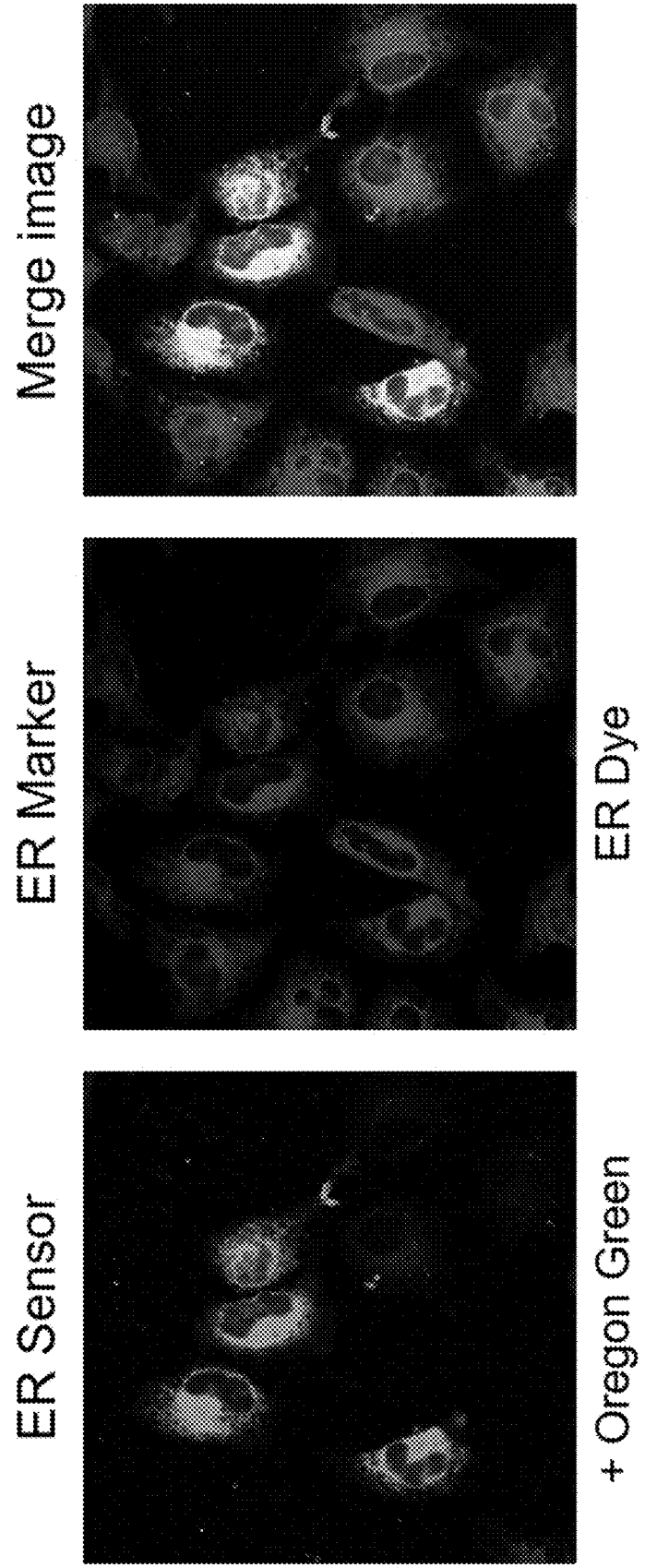

FIG. 221. ER sensor—mammalian cell expression and fluorescence imaging. Immunofluorescence images of endoplasmic reticulumn sensor (ER) in Hela cells showed its ER localization. DNA stain in blue. Left: green channdel only; Middle: red channel only; Right: overlay.

Figure 222:
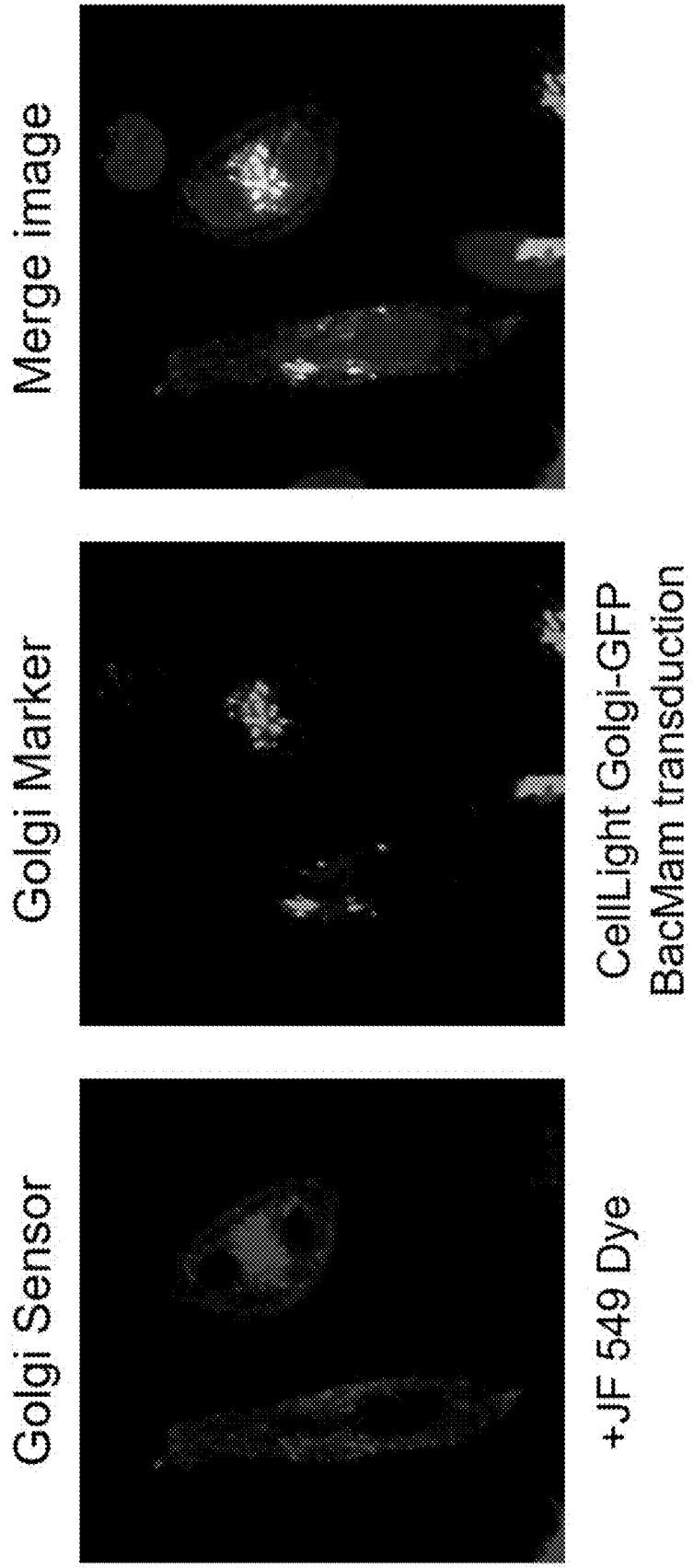

FIG. 222. Golgi sensor—mammalian cell expression and fluorescence imaging. Immunofluorescence images of Golgi sensor in Hela cells showed its Golgi localization. Golgi-GFP marker only stained for cis-Golgi. A portion of our Golgi sensor did not co-localize with Golgi-GFP marker, suggesting our Golgi sensor might reside in both cis- and trans-Golgi. DNA stain in blue. Left: red channdel only; Middle: green channel only; Right: overlay.

Figure 223:
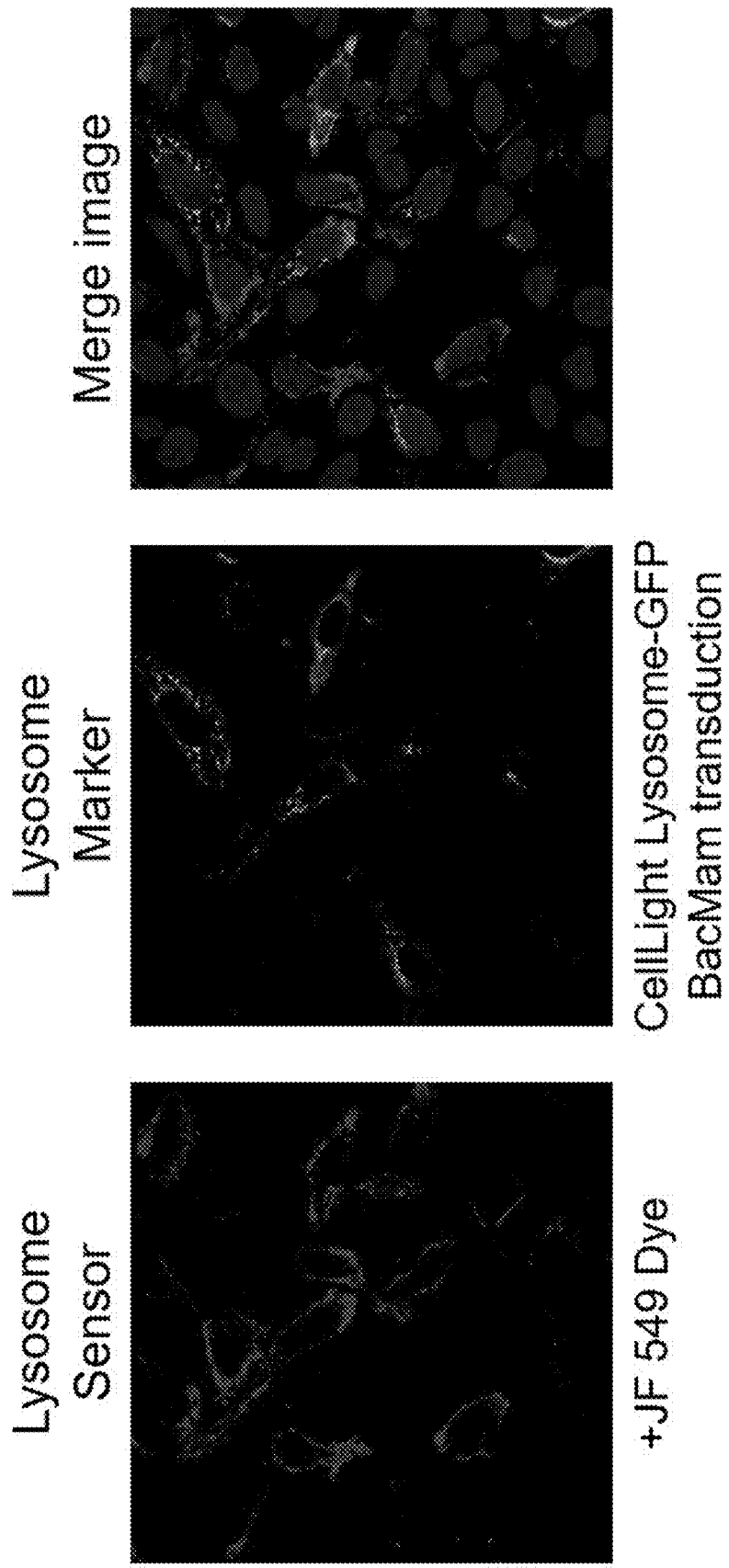

FIG. 223. Lysosome sensor—mammalian cell expression and fluorescence imaging. Immunofluoresence images of lysosome sensor in HeLa cells showed its localization to the lysosome. DNA stain in blue. Left: red channel only, Middle: green channel only; Right: overlay.

Figure 224:
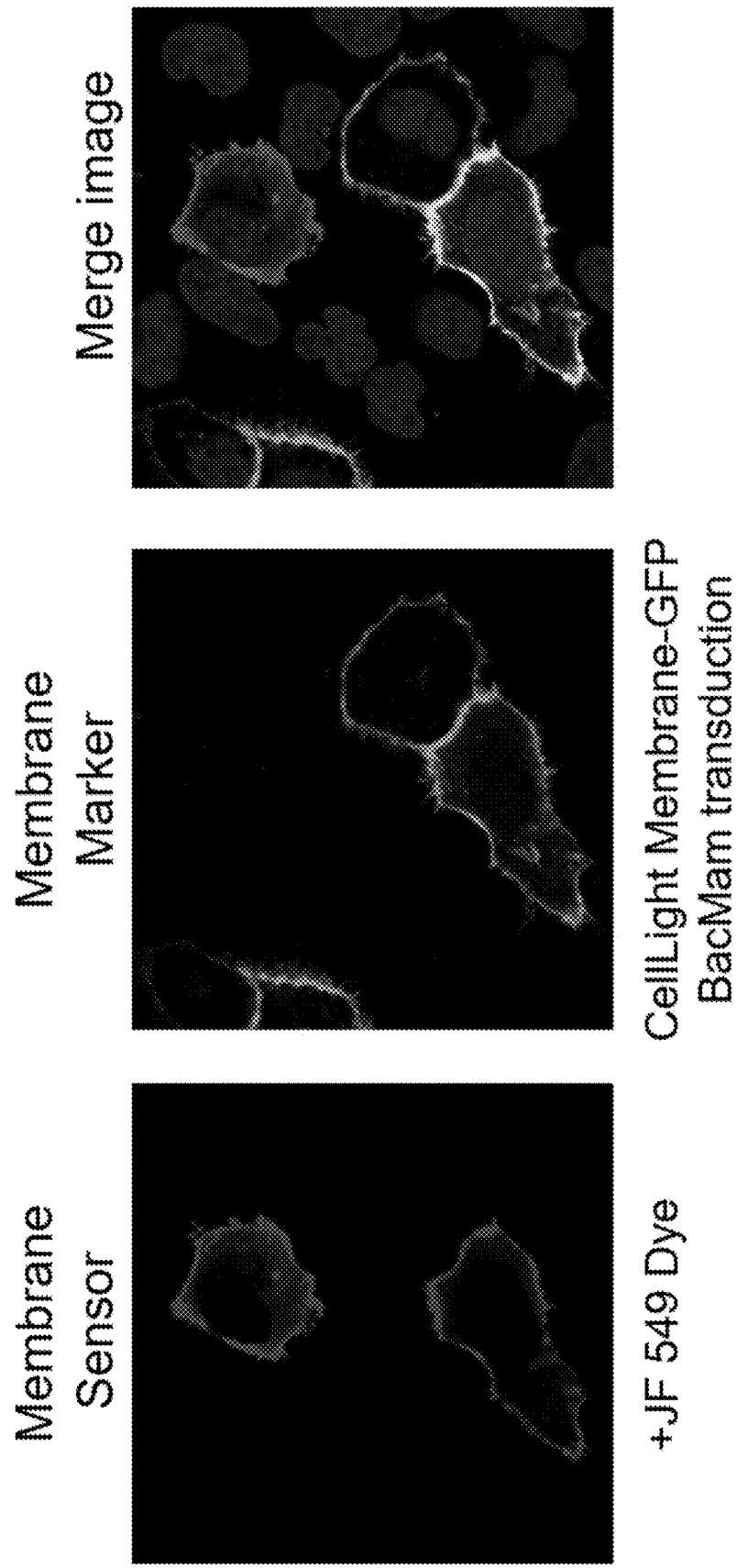

FIG. 224. Membrane sensor—mammalian cell expression and fluorescence imaging. Immunofluoresence images of membrane sensor in HeLa cells showed its localization to the plasma membrane. DNA stain in blue. Left: red channel only, Middle: green channel only; Right: overlay.

FIG. 225. Membrane sensor—mammalian cell expression and luminescence assays. Translocation of PKCα under PMA stimulation. PKCα-HiBiT clone (HeLa) was transiently transfected with membrane sensors. Transfected cells were treated with phorbol-12-myristate-13 acetate (PMA) and measured kinetically. All 3 membrane sensors resulted in similar $EC_{50}$, suggesting the affinity of LgBiT variants to HiBiT do not effect translocation events of PKCα.

Figure 226:
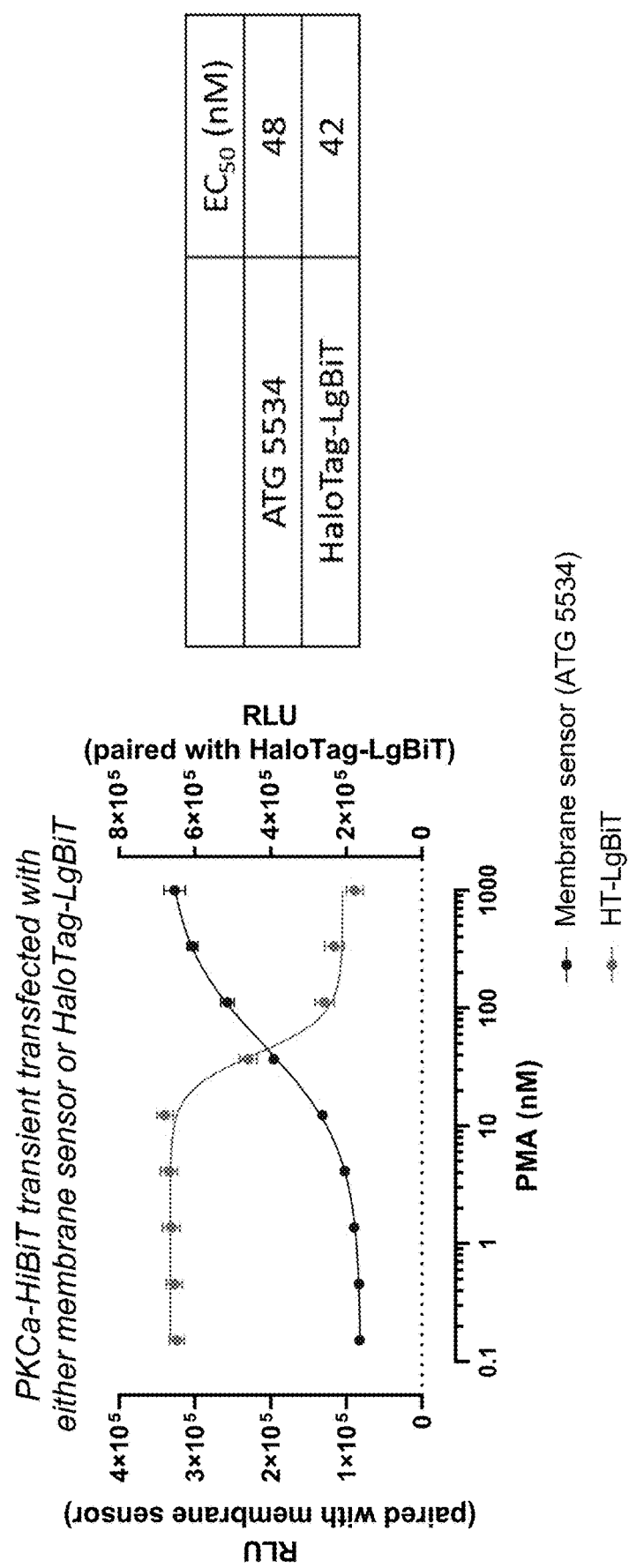

FIG. 226. Membrane/HaloTag®-LgBiT sensor—mammalian cell expression and luminescence assays. Reversibility of HiBiT-LgBiT® complex. Increased PMA concentration recruits more PKCα to the plasma membrane, resulting in higher luminescence signal, as more PKCα-HiBiT complementing with LgBiT® membrane sensor. Conversely, less PKCα accumulates in the cytosol; thus, decreasing luminescence signal as pairing with HaloTag®-LgBiT (cytosolic sensor).

Figure 227:
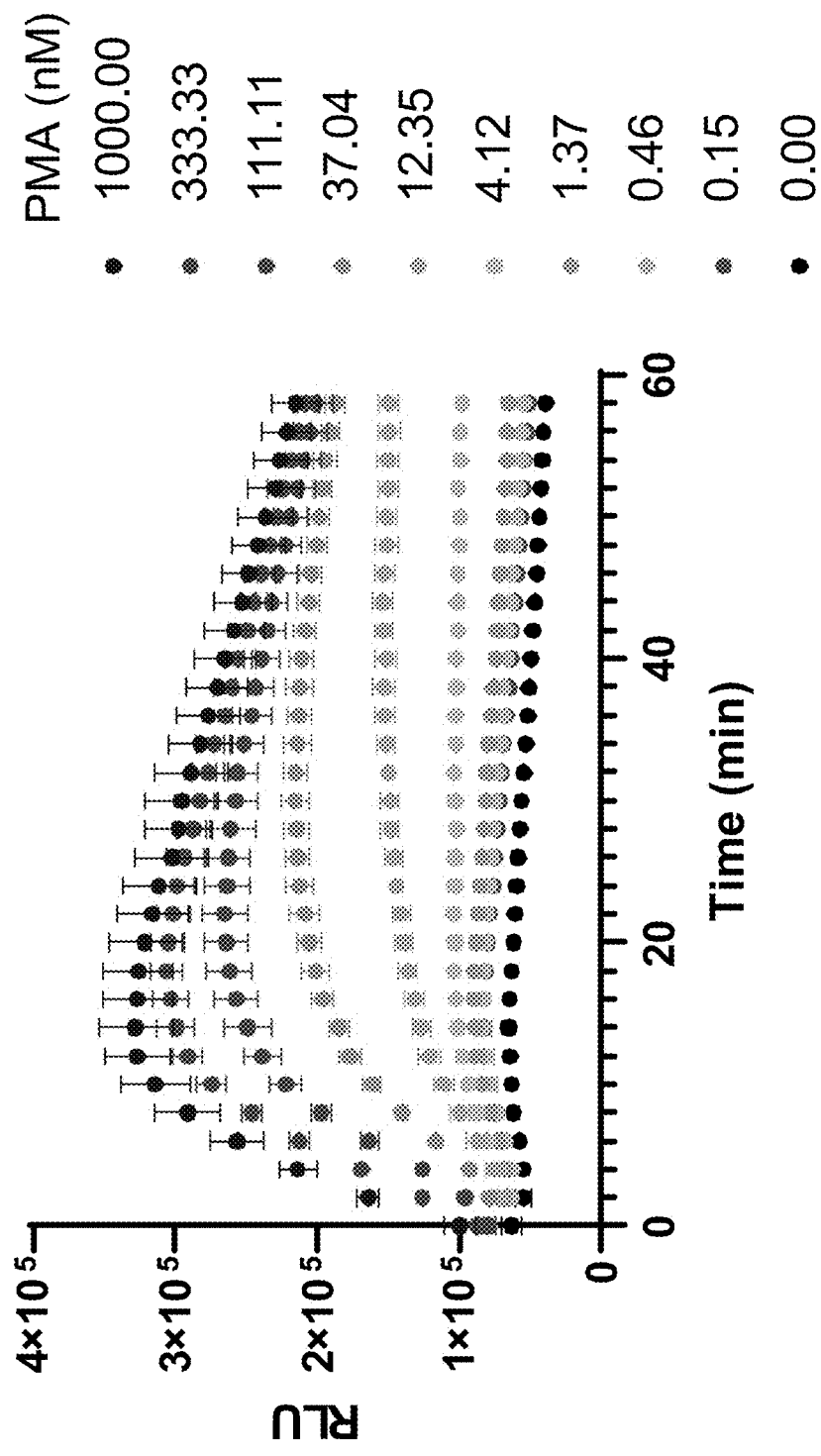

FIG. 227. Translocation event of PKCα. Kinetic measurement of PKCα translocation event. Accumulation of PKCα to the plasma membrane can be measured kinetically, when paired with membrane sensor. Under PMA stimulation, PKCα reaches its maximum accumulation to the plasma membrane at t=16 min.

DEFINITIONS

Although any methods and materials similar or equivalent to those described herein can be used in the practice or testing of embodiments described herein, some preferred methods, compositions, devices, and materials are described herein. However, before the present materials and methods are described, it is to be understood that this invention is not limited to the particular molecules, compositions, methodologies or protocols herein described, as these may vary in accordance with routine experimentation and optimization. It is also to be understood that the terminology used in the description is for the purpose of describing the particular versions or embodiments only, and is not intended to limit the scope of the embodiments described herein.

Unless otherwise defined, all technical and scientific terms used herein have the same meaning as commonly understood by one of ordinary skill in the art to which this invention belongs. However, in case of conflict, the present specification, including definitions, will control. Accordingly, in the context of the embodiments described herein, the following definitions apply.

As used herein and in the appended claims, the singular forms "a", "an" and "the" include plural reference unless the context clearly dictates otherwise. Thus, for example, reference to "a peptide" is a reference to one or more peptides and equivalents thereof known to those skilled in the art, and so forth.

As used herein, the term "and/or" includes any and all combinations of listed items, including any of the listed items individually. For example, "A, B, and/or C" encompasses A, B, C, AB, AC, BC, and ABC, each of which is to be considered separately described by the statement "A, B, and/or C."

As used herein, the term "comprise" and linguistic variations thereof denote the presence of recited feature(s), element(s), method step(s), etc. without the exclusion of the presence of additional feature(s), element(s), method step(s), etc. Conversely, the term "consisting of" and linguistic variations thereof, denotes the presence of recited feature(s), element(s), method step(s), etc. and excludes any unrecited feature(s), element(s), method step(s), etc., except for ordinarily-associated impurities. The phrase "consisting essentially of" denotes the recited feature(s), element(s), method step(s), etc. and any additional feature(s), element(s), method step(s), etc. that do not materially affect the basic nature of the composition, system, or method. Many embodiments herein are described using open "comprising" language. Such embodiments encompass multiple closed "consisting of" and/or "consisting essentially of" embodiments, which may alternatively be claimed or described using such language.

As used herein, the term "substantially" means that the recited characteristic, parameter, and/or value need not be achieved exactly, but that deviations or variations, including for example, tolerances, measurement error, measurement accuracy limitations and other factors known to skill in the art, may occur in amounts that do not preclude the effect the characteristic was intended to provide. A characteristic or feature that is substantially absent (e.g., substantially non-luminescent) may be one that is within the noise, beneath background, below the detection capabilities of the assay being used, or a small fraction (e.g., <1%, <0.1%, <0.01%, <0.001%, <0.00001%, <0.000001%, <0.0000001%) of the significant characteristic (e.g., luminescent intensity of a bioluminescent protein or bioluminescent complex).

As used herein, the term "bioluminescence" refers to production and emission of light by a chemical reaction catalyzed by, or enabled by, an enzyme, protein, protein complex, or other biomolecule (e.g., bioluminescent complex). In typical embodiments, a substrate for a bioluminescent entity (e.g., bioluminescent protein or bioluminescent complex) is converted into an unstable form by the bioluminescent entity; the substrate subsequently emits light.

As used herein the term "complementary" refers to the characteristic of two or more structural elements (e.g., peptide, polypeptide, nucleic acid, small molecule, etc.) of being able to hybridize, dimerize, or otherwise form a complex with each other. For example, a "complementary peptide and polypeptide" are capable of coming together to form a complex. Complementary elements may require assistance (facilitation) to form a complex (e.g., from interaction elements), for example, to place the elements in the proper conformation for complementarity, to place the elements in the proper proximity for complementarity, to co-localize complementary elements, to lower interaction energy for complementary, to overcome insufficient affinity for one another, etc.

As used herein, the term "complex" refers to an assemblage or aggregate of molecules (e.g., peptides, polypeptides, etc.) in direct and/or indirect contact with one another. In one aspect, "contact," or more particularly, "direct contact" means two or more molecules are close enough so that attractive noncovalent interactions, such as Van der Waal forces, hydrogen bonding, ionic and hydrophobic interactions, and the like, dominate the interaction of the molecules. In such an aspect, a complex of molecules (e.g., peptides and polypeptide) is formed under assay conditions such that the complex is thermodynamically favored (e.g., compared to a non-aggregated, or non-complexed, state of its component molecules). As used herein the term "complex," unless described as otherwise, refers to the assemblage of two or more molecules (e.g., peptides, polypeptides or a combination thereof).

As used herein, the term "non-luminescent" refers to an entity (e.g., peptide, polypeptide, complex, protein, etc.) that exhibits the characteristic of not emitting a detectable amount of light in the visible spectrum (e.g., in the presence of a substrate). For example, an entity may be referred to as non-luminescent if it does not exhibit detectable luminescence in a given assay. As used herein, the term "non-luminescent" is synonymous with the term "substantially non-luminescent. In some embodiments, an entity is considered "non-luminescent" if any light emission is sufficiently minimal so as not to create interfering background for a particular assay.

As used herein, the terms "non-luminescent peptide" and "non-luminescent polypeptide" refer to peptides and polypeptides that exhibit substantially no luminescence (e.g., in the presence of a substrate), or an amount that is beneath the noise (e.g., 100-fold, 200-fold, 500-fold, $1\times10^3$-fold, $1\times10^4$-fold, $1\times10^5$-fold, $1\times10^6$-fold, $1\times10^7$-fold, etc.) when compared to a significant signal (e.g., a bioluminescent complex) under standard conditions (e.g., physiological conditions, assay conditions, etc.) and with typical instrumentation (e.g., luminometer, etc.). In some embodiments, such non-luminescent peptides and polypeptides assemble, according to the criteria described herein, to form a bioluminescent complex.

As used herein, the term "interaction element" refers to a moiety that assists or facilitates the bringing together of non-luminescent elements to form a bioluminescent complex. In some embodiments, a pair of interaction elements (a.k.a. "interaction pair") is attached to a pair of non-luminescent elements (e.g., non-luminescent peptides), and the attractive interaction between the two interaction elements facilitates formation of the bioluminescent complex; although the present invention is not limited to such a mechanism, and an understanding of the mechanism is not required to practice the invention. Interaction elements may facilitate formation of the bioluminescent complex by any suitable mechanism (e.g., bringing non-luminescent elements into close proximity, placing a non-luminescent element in proper conformation for stable interaction, reducing activation energy for complex formation, combinations thereof, etc.). An interaction element may be a protein, polypeptide, peptide, small molecule, cofactor, nucleic acid, lipid, carbohydrate, antibody, etc. An interaction pair may be made of two of the same interaction elements (i.e., homopair) or two different interaction elements (i.e., heteropair). In the case of a heteropair, the interaction elements may be the same type of moiety (e.g., polypeptides) or may be two different types of moieties (e.g., polypeptide and small molecule). In some embodiments, in which complex formation by the interaction pair is studied, an interaction pair may be referred to as a "target pair" or a "pair of interest," and the individual interaction elements are referred to as "target elements" (e.g., "target peptide," "target polypeptide," etc.) or "elements of interest" (e.g., "peptide of interest," "polypeptide or interest," etc.).

As used herein, the term "low affinity" describes an intermolecular interaction between two or more (e.g., three) entities that is too weak to result in significant complex formation between the entities, except at concentrations substantially higher (e.g., 2-fold, 5-fold, 10-fold, 100-fold, 1000-fold, or more) than physiologic or assay conditions, or with facilitation from the formation of a second complex of attached elements (e.g., interaction elements).

As used herein, the term "high affinity" describes an intermolecular interaction between two or more (e.g., three) entities that is of sufficient strength to produce detectable complex formation under physiologic or assay conditions, without facilitation from the formation of a second complex of attached elements (e.g., interaction elements).

As used herein, the term "co-localization element" refers to a moiety that facilitates co-localization of non-luminescent elements. In some embodiments, a set of non-luminescent elements has sufficient affinity to form a complex when the non-luminescent elements are co-localized at sufficient concentration. In such embodiments, a set (e.g., pair) of co-localization elements (a.k.a. "co-localization pair") is attached to a pair of non-luminescent elements (e.g., non-luminescent peptides), and the co-localization (e.g., within a cellular compartment, within a tissue, within a solution, on a solid matrix support, etc.) of the two co-localization elements facilitates co-localization of the non-luminescent elements, thereby facilitating formation of the bioluminescent complex; although the present invention is not limited to such a mechanism, and an understanding of the mechanism is not required to practice the invention. In some embodiments, due to the capacity of the non-luminescent elements to self-assemble into a luminescent complex, the co-localization elements need not directly interact to facilitate complex formation. A co-localization element may be a protein, polypeptide, peptide, small molecule, cofactor, nucleic acid, lipid, carbohydrate, antibody, etc. A co-localization pair may be made of two of the same co-localization elements (i.e., homopair) or two different co-localization elements (i.e., heteropair). In the case of a heteropair, the co-localization elements may be the same type of moiety (e.g., polypeptides) or may be two different types of moieties (e.g., polypeptide and small molecule). In some embodiments, in which the localization of the co-localization pair is studied, a co-localization pair may be referred to as a "target pair" or a "pair of interest," and the individual co-localization elements are referred to as "target elements" (e.g., "target peptide," "target polypeptide," etc.) or "elements of interest" (e.g., "peptide of interest," "polypeptide or interest," etc.).

As used herein, the term "coelenterazine" refers to naturally-occurring ("native") coelenterazine. As used herein, the term "coelenterazine analog" or "coelenterazine derivative" refers to synthetic (e.g., derivative or variant) and natural analogs thereof, including furimazine, coelenterazine-n, coelenterazine-f, coelenterazine-h, coelenterazine-hcp, coelenterazine-cp, coelenterazine-c, coelenterazine-e, coelenterazine-fcp, bis-deoxycoelenterazine ("coelenterazine-hh"), coelenterazine-i, coelenterazine-icp, coelenterazine-v, and 2-methyl coelenterazine, in addition to those disclosed in WO 2003/040100; U.S. application Ser. No. 12/056,073 (paragraph [0086]); U.S. Pat. No. 8,669,103; WO 2012/061529, U.S. Pat. Pub. 2017/0233789 and U.S. Pat. Pub. 2018/0030059; the disclosures of which are incorporated by reference herein in their entireties. In some embodiments, coelenterazine analogs include pro-substrates such as, for example, those described in U.S. application Ser. No. 12/056,073; U.S. Pub. No. 2012/0707849; U.S. Pub. No. 2014/0099654; herein incorporated by reference in their entireties.

As used herein, the term "preexisting protein" refers to an amino acid sequence that was in physical existence prior to a certain event or date. A "peptide that is not a fragment of a preexisting protein" is a short amino acid chain that is not a fragment or sub-sequence of a protein (e.g., synthetic or naturally-occurring) that was in physical existence prior to the design and/or synthesis of the peptide.

As used herein, the term "fragment" refers to a peptide or polypeptide that results from dissection or "fragmentation" of a larger whole entity (e.g., protein, polypeptide, enzyme, etc.), or a peptide or polypeptide prepared to have the same sequence as such. Therefore, a fragment is a subsequence of the whole entity (e.g., protein, polypeptide, enzyme, etc.) from which it is made and/or designed. A peptide or polypeptide that is not a subsequence of a preexisting whole protein is not a fragment (e.g., not a fragment of a preexisting protein). A peptide or polypeptide that is "not a fragment of a preexisting bioluminescent protein" is an amino acid chain that is not a subsequence of a protein (e.g., natural or synthetic) that: (1) was in physical existence prior to design and/or synthesis of the peptide or polypeptide, and (2) exhibits substantial bioluminescent activity.

As used herein, the term "subsequence" refers to peptide or polypeptide that has 100% sequence identify with a portion of another, larger peptide or polypeptide. The subsequence is a perfect sequence match for a portion of the larger amino acid chain.

The term "amino acid" refers to natural amino acids, unnatural amino acids, and amino acid analogs, all in their D and L stereoisomers, unless otherwise indicated, if their structures allow such stereoisomeric forms.

Natural amino acids include alanine (Ala or A), arginine (Arg or R), asparagine (Asn or N), aspartic acid (Asp or D), cysteine (Cys or C), glutamine (Gln or Q), glutamic acid (Glu or E), glycine (Gly or G), histidine (His or H), isoleucine (Ile or I), leucine (Leu or L), Lysine (Lys or K), methionine (Met or M), phenylalanine (Phe or F), proline (Pro or P), serine (Ser or S), threonine (Thr or T), tryptophan (Trp or W), tyrosine (Tyr or Y) and valine (Val or V).

Unnatural amino acids include, but are not limited to, pentafluorophenylalanine ("Z"), azetidinecarboxylic acid, 2-aminoadipic acid, 3-aminoadipic acid, beta-alanine, naphthylalanine ("naph"), aminopropionic acid, 2-aminobutyric acid, 4-aminobutyric acid, 6-aminocaproic acid, 2-aminoheptanoic acid, 2-aminoisobutyric acid, 3-aminoisbutyric acid, 2-aminopimelic acid, tertiary-butylglycine ("tBuG"), 2,4-diaminoisobutyric acid, desmosine, 2,2'-diaminopimelic acid, 2,3-diaminopropionic acid, N-ethylglycine, N-ethylasparagine, homoproline ("hPro" or "homoP"), hydroxylysine, allo-hydroxylysine, 3-hydroxyproline ("3Hyp"), 4-hydroxyproline ("4Hyp"), isodesmosine, allo-isoleucine, N-methylalanine ("MeAla" or "Nime"), N-alkylglycine ("NAG") including N-methylglycine, N-methylisoleucine, N-alkylpentylglycine ("NAPG") including N-methylpentylglycine. N-methylvaline, naphthylalanine, norvaline ("Norval"), norleucine ("Norleu"), octylglycine ("OctG"), omithine ("Orn"), pentylglycine ("pG" or "PGly"), pipecolic acid, thioproline ("ThioP" or "tPro"), homoLysine ("hLys"), and homoArginine ("hArg"). Unnatural reactive amino acids are described in, for example, Boutureira, O. and G. J. Bernardes (2015) "Advances in chemical protein modification." Chem Rev 115(5): 2174-2195; herein incorporated by reference in its entirety.

The term "amino acid analog" refers to a natural or unnatural amino acid where one or more of the C-terminal carboxy group, the N-terminal amino group and side-chain bioactive group has been chemically blocked, reversibly or irreversibly, or otherwise modified to another bioactive group. For example, aspartic acid-(beta-methyl ester) is an amino acid analog of aspartic acid; N-ethylglycine is an amino acid analog of glycine; or alanine carboxamide is an amino acid analog of alanine. Other amino acid analogs include methionine sulfoxide, methionine sulfone, S-(carboxymethyl)-cysteine, S-(carboxymethyl)-cysteine sulfoxide and S-(carboxymethyl)-cysteine sulfone. Amino acid analogs may comprise amino acids with various protecting groups (Isidro-Llobet, A., et al. (2009). "Amino Acid-Protecting Groups." Chemical Reviews 109(6): 2455-2504; herein incorporated by reference in its entirety).

As used herein, unless otherwise specified, the terms "peptide" and "polypeptide" refer to polymer compounds of two or more amino acids joined through the main chain by peptide amide bonds (—C(O)NH—). The term "peptide" typically refers to short amino acid polymers (e.g., chains having fewer than 30 amino acids), whereas the term "polypeptide" typically refers to longer amino acid polymers (e.g., chains having more than 30 amino acids).

As used herein, unless otherwise specified, the term "dipeptide" refers to a peptide or small polypeptide (e.g., <70 amino acids, <60 amino acids, <50 amino acids, etc.) comprising two peptide segments (e.g., corresponding to two beta strands of a luciferase (e.g., a "β9/β10 dipeptide," corresponding to the β9 and β10 strands of an OgLuc luciferase polypeptide), fused/attached directly or indirectly (e.g., via a linker (e.g., peptide linker (e.g., 1-10 amino acids (e.g., a single glycine)))).

As used herein, unless otherwise specified, the term "tripeptide" refers to a peptide or small polypeptide (e.g., <100 amino acids, <90 amino acids, <80 amino acids, etc.) comprising three peptide segments (e.g., corresponding to three beta strands of a luciferase (e.g., a "08-10 tripeptide," corresponding to the 08-10 strands of an OgLuc luciferase polypeptide), fused/attached directly or indirectly (e.g., via a linker (e.g., peptide linker (e.g., 1-10 amino acids (e.g., a single glycine)))).

As used herein, terms "peptidomimetic" and "peptide mimetic" refer to peptide-like or polypeptide-like molecules that emulate a sequence derived from a protein or peptide. A peptidomimetic may contain amino acids analogs, peptoid amino acids, and/or non-amino acid components either exclusively or in combination with amino acids (e.g., natural or non-natural amino acids). Examples of peptidomimitecs include chemically modified peptides/polypeptides, peptoids (side chains are appended to the nitrogen atom of the peptide backbone rather than to the α-carbons), β-peptides (amino group bonded to the R carbon rather than the a carbon), etc.

As used herein, the term "peptoid" refers to a class of peptidomimetics where the side chains are functionalized on the nitrogen atom of the peptide backbone rather than to the α-carbon.

As used herein, the term "artificial" refers to compositions and systems that are designed or prepared by man and are not naturally occurring. For example, an artificial peptide, peptoid, or nucleic acid is one comprising a non-natural sequence (e.g., a peptide without 100% identity with a naturally-occurring protein or a fragment thereof).

As used herein, a "conservative" amino acid substitution refers to the substitution of an amino acid in a peptide or polypeptide with another amino acid having similar chemical properties such as size or charge. For purposes of the present disclosure, each of the following eight groups contains amino acids that are conservative substitutions for one another:
1) Alanine (A) and Glycine (G);
2) Aspartic acid (D) and Glutamic acid (E);
3) Asparagine (N) and Glutamine (Q);
4) Arginine (R) and Lysine (K);
5) Isoleucine (I), Leucine (L), Methionine (M), and Valine (V);
6) Phenylalanine (F), Tyrosine (Y), and Tryptophan (W);
7) Serine (S) and Threonine (T); and
8) Cysteine (C) and Methionine (M).

Naturally occurring residues may be divided into classes based on common side chain properties, for example: polar positive (or basic) (histidine (H), lysine (K), and arginine (R)); polar negative (or acidic) (aspartic acid (D), glutamic acid (E)); polar neutral (serine (S), threonine (T), asparagine (N), glutamine (Q)); non-polar aliphatic (alanine (A), valine (V), leucine (L), isoleucine (I), methionine (M)); non-polar aromatic (phenylalanine (F), tyrosine (Y), tryptophan (W)); proline and glycine; and cysteine. As used herein, a "semi-conservative" amino acid substitution refers to the substitution of an amino acid in a peptide or polypeptide with another amino acid within the same class.

In some embodiments, unless otherwise specified, a conservative or semi-conservative amino acid substitution may also encompass non-naturally occurring amino acid residues that have similar chemical properties to the natural residue. These non-natural residues are typically incorporated by chemical peptide synthesis rather than by synthesis in biological systems. These include, but are not limited to, peptidomimetics and other reversed or inverted forms of amino acid moieties. Embodiments herein may, in some embodiments, be limited to natural amino acids, non-natural amino acids, and/or amino acid analogs.

Non-conservative substitutions may involve the exchange of a member of one class for a member from another class.

As used herein, the term "sequence identity" refers to the degree two polymer sequences (e.g., peptide, polypeptide, nucleic acid, etc.) have the same sequential composition of monomer subunits. The term "sequence similarity" refers to the degree with which two polymer sequences (e.g., peptide, polypeptide, nucleic acid, etc.) have similar polymer sequences. For example, similar amino acids are those that share the same biophysical characteristics and can be grouped into the families, e.g., acidic (e.g., aspartate, glutamate), basic (e.g., lysine, arginine, histidine), non-polar (e.g., alanine, valine, leucine, isoleucine, proline, phenylalanine, methionine, tryptophan) and uncharged polar (e.g., glycine, asparagine, glutamine, cysteine, serine, threonine, tyrosine). The "percent sequence identity" (or "percent sequence similarity") is calculated by: (1) comparing two optimally aligned sequences over a window of comparison (e.g., the length of the longer sequence, the length of the shorter sequence, a specified window), (2) determining the number of positions containing identical (or similar) monomers (e.g., same amino acids occurs in both sequences, similar amino acid occurs in both sequences) to yield the number of matched positions, (3) dividing the number of matched positions by the total number of positions in the comparison window (e.g., the length of the longer sequence, the length of the shorter sequence, a specified window), and (4) multiplying the result by 100 to yield the percent sequence identity or percent sequence similarity. For example, if peptides A and B are both 20 amino acids in length and have identical amino acids at all but 1 position, then peptide A and peptide B have 95% sequence identity. If the amino acids at the non-identical position shared the same biophysical characteristics (e.g., both were acidic), then peptide A and peptide B would have 100% sequence similarity. As another example, if peptide C is 20 amino acids in length and peptide D is 15 amino acids in length, and 14 out of 15 amino acids in peptide D are identical to those of a portion of peptide C, then peptides C and D have 70% sequence identity, but peptide D has 93.3% sequence identity to an optimal comparison window of peptide C. For the purpose of calculating "percent sequence identity" (or "percent sequence similarity") herein, any gaps in aligned sequences are treated as mismatches at that position.

Any peptide/polypeptides described herein as having a particular percent sequence identity or similarity (e.g., at least 70%) with a reference sequence ID number, may also be expressed as having a maximum number of substitutions (or terminal deletions) with respect to that reference sequence. For example, a sequence having at least Y % sequence identity (e.g., 90%) with SEQ ID NO:Z (e.g., 100 amino acids) may have up to X substitutions (e.g., 10) relative to SEQ ID NO:Z, and may therefore also be expressed as "having X (e.g., 10) or fewer substitutions relative to SEQ ID NO:Z."

As used herein, the term "wild-type," refers to a gene or gene product (e.g., protein, polypeptide, peptide, etc.) that has the characteristics (e.g., sequence) of that gene or gene product isolated from a naturally occurring source, and is most frequently observed in a population. In contrast, the term "mutant" or "variant" refers to a gene or gene product that displays modifications in sequence when compared to the wild-type gene or gene product. It is noted that "naturally-occurring variants" are genes or gene products that occur in nature, but have altered sequences when compared to the wild-type gene or gene product; they are not the most commonly occurring sequence. "Artificial variants" are genes or gene products that have altered sequences when compared to the wild-type gene or gene product and do not occur in nature. Variant genes or gene products may be naturally occurring sequences that are present in nature, but not the most common variant of the gene or gene product, or "synthetic," produced by human or experimental intervention.

As used herein, the term "physiological conditions" encompasses any conditions compatible with living cells, e.g., predominantly aqueous conditions of a temperature, pH, salinity, chemical makeup, etc. that are compatible with living cells.

As used herein, the term "sample" is used in its broadest sense. In one sense, it is meant to include a specimen or culture obtained from any source, as well as biological and environmental samples. Biological samples may be obtained from animals (including humans) and encompass fluids, solids, tissues, and gases. Biological samples include blood products, such as plasma, serum, and the like. Sample may also refer to cell lysates or purified forms of the enzymes, peptides, and/or polypeptides described herein. Cell lysates may include cells that have been lysed with a lysing agent or lysates such as rabbit reticulocyte or wheat germ lysates. Sample may also include cell-free expression systems. Environmental samples include environmental material such as surface matter, soil, water, crystals, and industrial samples. A/G, protein L, protein M), oligonucleotide probe, peptide nucleic acid, DARPin, aptamer, affimer, a purified protein (either the analyte itself or a protein that binds to the analyte), and analyte binding domain(s) of proteins etc. Table A provides a lists of exemplary binding moieties that could be used singly or in various combinations in methods, systems, and assays (e.g., immunoassays) herein.

TABLE A

Exemplary binding moieties

| Binding Moiety A | Binding Moiety B |
|---|---|
| Protein A | Protein A |
| Ig Binding domain of protein A | Ig binding domain of protein A |
| Protein G | Protein G |
| Ig Binding domain of protein G | Ig binding domain of protein G |
| Protein L | Protein L |
| Ig Binding domain of protein L | Ig binding domain of protein L |
| Protein M | Protein M |
| Ig Binding domain of protein M | Ig binding domain of protein M |
| polyclonal antibody against analyte X | polyclonal antibody: same antibody or second polyclonal antibody recognizing same target analyte X |
| monoclonal antibody | monoclonal antibody recognizing different epitope on same target analyte X |
| recombinant antibody | recombinant antibody recognizing different epitope on same target analyte X |
| scFv | scFv recognizing different epitope on same target analyte X |
| variable light chain ($V_L$) of antibody (monoclonal, recombinant, polyclonal) recognizing target analyte X | variable heavy chain ($V_H$) of same antibody (monoclonal, recombinant, polyclonal) recognizing target analyte X |
| protein (e.g. receptor) binding domain 1 that binds to analyte X | protein (e.g. receptor) binding domain 2 that binds to analyte X |
| (Fab) fragment | (Fab) fragment from different antibody recognizing different epitope to same target analyte X |
| Fab' fragment | Fab' from different antibody recognizing different epitope to same target analyte X |
| Fv fragment | Fv from different antibody recognizing different epitope to same target analyte X |
| F(ab')2 fragment | F(ab')2 from different antibody recognizing different epitope to same target analyte X |
| oligonucleotide probe | oligonucleotide probe to same DNA or RNA target but recognizing non-overlapping sequence |
| DARPin | DARPin recognizing non-overlapping domain of same target |
| peptide nucleic acid | peptide nucleic acid recognizing same DNA or RNA target but non-overlapping sequence |
| aptamer | aptamer binding to same target analyte X but recognizing non-overlapping sequence or epitope |
| affimer | aptamer binding to same target analyte X but recognizing different epitope |

Such examples are not however to be construed as limiting the sample types applicable to the present invention.

As used herein, the terms "fusion," "fusion polypeptide," and "fusion protein" refer to a chimeric protein containing a first protein or polypeptide of interest (e.g., substantially non-luminescent peptide) joined to a second different peptide, polypeptide, or protein (e.g., interaction element).

As used herein, the terms "conjugated" and "conjugation" refer to the covalent attachment of two molecular entities (e.g., post-synthesis and/or during synthetic production). The attachment of a peptide or small molecule tag to a protein or small molecule, chemically (e.g., "chemically" conjugated) or enzymatically, is an example of conjugation.

The term "binding moiety" refers to a domain that specifically binds an antigen or epitope independently of a different epitope or antigen binding domain. A binding moiety may be an antibody, antibody fragment, a receptor domain that binds a target ligand, proteins that bind to immunoglobulins (e.g., protein A, protein G, protein A/G, protein L, protein M), a binding domain of a proteins that bind to immunoglobulins (e.g., protein A, protein G, protein As used herein, the term "antibody" refers to a whole antibody molecule or a fragment thereof (e.g., fragments such as Fab, Fab', and F(ab')$_2$, variable light chain, variable heavy chain, Fv, it may be a polyclonal or monoclonal or recombinant antibody, a chimeric antibody, a humanized antibody, a human antibody, etc. As used herein, when an antibody or other entity "specifically recognizes" or "specifically binds" an antigen or epitope, it preferentially recognizes the antigen in a complex mixture of proteins and/or macromolecules, and binds the antigen or epitope with affinity which is substantially higher than to other entities not displaying the antigen or epitope. In this regard, "affinity which is substantially higher" means affinity that is high enough to enable detection of an antigen or epitope which is distinguished from entities using a desired assay or measurement apparatus. Typically, it means binding affinity having a binding constant ($K_a$) of at least $10^7$ M$^{-1}$ (e.g., >$10^7$ M$^{-1}$, >$10^8$ M$^{-1}$, >$^9$M$^{-1}$, >$10^{10}$ M$^{-1}$, >$10^{11}$ M$^{-1}$, >$10^{12}$ M$^{-1}$, >$10^{13}$ M$^{-1}$, etc.). In certain such embodiments, an antibody is capable of binding different antigens so long as the different antigens comprise that particular epitope. In certain instances, for example, homologous proteins from different species may comprise the same epitope.

As used herein, the term "antibody fragment" refers to a portion of a full-length antibody, including at least a portion of the antigen binding region or a variable region. Antibody fragments include, but are not limited to, Fab, Fab', F(ab')$_2$, Fv, scFv, Fd, variable light chain, variable heavy chain, diabodies, and other antibody fragments that retain at least a portion of the variable region of an intact antibody. See, e.g., Hudson et al. (2003) Nat. Med. 9:129-134; herein incorporated by reference in its entirety. In certain embodiments, antibody fragments are produced by enzymatic or chemical cleavage of intact antibodies (e.g., papain digestion and pepsin digestion of antibody) produced by recombinant DNA techniques, or chemical polypeptide synthesis. For example, a "Fab" fragment comprises one light chain and the CH and variable region of one heavy chain. The heavy chain of a Fab molecule cannot form a disulfide bond with another heavy chain molecule. A "Fab'" fragment comprises one light chain and one heavy chain that comprises additional constant region, extending between the $C_{H1}$ and $C_{H2}$ domains. An interchain disulfide bond can be formed between two heavy chains of a Fab' fragment to form a "F(ab')$_2$" molecule. An "Fv" fragment comprises the variable regions from both the heavy and light chains, but lacks the constant regions. A single-chain Fv (scFv) fragment comprises heavy and light chain variable regions connected by a flexible linker to form a single polypeptide chain with an antigen-binding region. Exemplary single chain antibodies are discussed in detail in WO 88/01649 and U.S. Pat. Nos. 4,946,778 and 5,260,203; herein incorporated by reference in their entireties. In certain instances, a single variable region (e.g., a heavy chain variable region or a light chain variable region) may have the ability to recognize and bind antigen. Other antibody fragments will be understood by skilled artisans.

As used herein, the term "peptide tag" refers to a peptide that may be attached (e.g., post-synthesis or during synthetic production) or fused to another entity (e.g., protein of interest, molecule of interest, interaction element, co-localization element, etc.). The peptide tag may or may not be attached to another entity. Typically, as used herein, a peptide tag is capable of forming a bioluminescent complex with another peptide tag and a polypeptide under appropriate conditions. In embodiments in which a peptide tag is attached to another entity, a peptide tag is chemically conjugated to another molecule (e.g., peptide, polypeptide, nucleic acid, other small molecules or macromolecules), chemically synthesized to be a part of another molecule, or genetically fused to another peptide or polypeptide molecule, etc. As used herein, the term "polypeptide component" is used synonymously with the term "polypeptide component of a bioluminescent complex." Typically, as used herein, a polypeptide component is capable of forming a bioluminescent complex with a pair of peptide tags, under appropriate conditions.

As used herein, the term "an Oplophorus luciferase" ("an OgLuc") refers to a luminescent polypeptide having significant sequence identity, structural conservation, and/or the functional activity of the luciferase produce by and derived from the deep-sea shrimp Oplophorus gracilirostris. In particular, an OgLuc polypeptide refers to a luminescent polypeptide having significant sequence identity, structural conservation, and/or the functional activity of the mature 19 kDa subunit of the Oplophorus luciferase protein complex (e.g., without a signal sequence) such as SEQ ID NOs: 1 (WT OgLuc) and 3 (NanoLuc®), which comprises 10β strands (β1, β2, β3, β4, β5, β6, β7, β8, β9, β10) and utilize substrates such as coelenterazine or coelenterazine derivatives to produce luminescence.

As used herein, the term "β9-like peptide" refers to a peptide (or peptide tag) comprising significant sequence identity, structural conservation, and/or the functional activity of the β (beta) 9 strand of an OgLuc polypeptide. In particular, a β9-like peptide is a peptide capable of structurally complementing an OgLuc polypeptide lacking a 19 strand resulting in enhanced luminescence of the complex compared to the OgLuc polypeptide in the absence of the β9-like peptide. Other "βX-like peptides" may be similarly named (e.g., β1-like, β2-like, β3-like, β4-like, β5-like, β6-like, β7-like, β8-like, β9-like).

As used herein, the term "β10-like peptide" refers to a peptide (or peptide tag) comprising significant sequence identity, structural conservation, and/or the functional activity of the β (beta) 10 strand of an OgLuc polypeptide. In particular, a β10-like peptide is a peptide capable of structurally complementing an OgLuc polypeptide lacking a β10 strand resulting in enhanced luminescence of the complex compared to the OgLuc polypeptide in the absence of the β10-like peptide. Other "βX-like peptides" may be similarly named (e.g., β1-like, β2-like, β3-like, β4-like, β5-like, β6-like, β7-like, β8-like, β9-like).

As used herein, the term "$\beta_{1-8}$-like polypeptide" refers to a polypeptide bearing sequence and structural similarity to β (beta) strands 1-8 of an OgLuc polypeptide, but lacking β (beta) strands 9 and 10. Other "$\beta_{Y-Z}$-like polypeptides" may be similarly named (e.g., $\beta_{1-4}$-like polypeptide, $\beta_{2-8}$-like polypeptide, $\beta_{5-10}$-like polypeptide, etc.).

As used herein, the term "NANOLUC" refers to an artificial luciferase or bioluminescent polypeptide produced commercially by the Promega Corporation and corresponding to SEQ ID NO: 3.

As used herein, the term "LgBiT" refers to a polypeptide corresponding to $\beta_{1-9}$-like polypeptide that finds use in, for example, binary complementation to form a bioluminescent complex and corresponds to SEQ ID NO: 11.

As used herein, the term "SmBiT" refers to a peptide corresponding to $\beta_{10}$-like peptide that finds use in, for example, binary complementation to form a bioluminescent complex, but has low affinity for LgBiT (e.g., requires facilitation for complex formation) and corresponds to SEQ ID NO: 13.

As used herein, the term "HiBiT" refers to a peptide corresponding to $\beta_{10}$-like peptide that finds use in, for example, binary complementation to form a bioluminescent complex, but has low affinity for LgBiT (e.g., requires facilitation for complex formation) and corresponds to SEQ ID NO: 15. HiBiT is has the same sequence as "SmHiTrip10" (SEQ ID NO: 25) and "pep86," terms which may be used interchangeably (also SmTrip10 pep86, etc.).

As used herein, the term "LgTrip" refers to a polypeptide corresponding to $\beta_{1-8}$-like polypeptide that corresponds to SEQ ID NO: 17 and finds use in, for example, tripartite complementation with β9-like and $\beta_{10}$-like peptides to form a bioluminescent complex, or binary complementation, with a $\beta_{9-10}$-like dipeptide to form a bioluminescent complex. LgTrip variants include: LgTrip 2098 (w/His tag: SEQ ID NO: 31; w/o His tag: SEQ ID NO: 304) and LgTrip 3546 (w/His tag: SEQ ID NO: 51; w/o His tag: SEQ ID NO: 302).

As used herein, the term "SmTrip10" refers to a peptide corresponding to $\beta_9$-like peptide that finds use in, for example, tripartite complementation to form a bioluminescent complex.

As used herein, the term "SmTrip9" refers to a peptide corresponding to β9-like peptide that finds use in, for example, tripartite complementation to form a bioluminescent complex.

DETAILED DESCRIPTION

Provided herein are bioluminescent polypeptides and compositions and methods for the assembly of a tripartite or multipartite bioluminescent complex. In particular embodiments, a bioluminescent complex is formed upon the interaction of three or more peptide and/or polypeptide components.

Experiments conducted during development of embodiments herein demonstrate that a tripartite luciferase comprising two small peptide elements (e.g., a β10-like peptide and β9-like peptide) and one polypeptide element (e.g., $β_{1-8}$-like polypeptide) assemble to form a luminescent complex. Experiments conducted during development of embodiments herein further demonstrate the formation of a bioluminescent complex from up to five fragments of a luciferase (or variants of such fragments), such as a polypeptide fragment (or variants thereof) and one or more peptide, dipeptide, or tripeptide fragments (or variants of such fragments).

The commercially-available NANOLUC luciferase (Promega Corporation) comprises 10β (beta) strands (β1, β2, β3, β4, β5, β6, β7, β8, β9, β10). U.S. Pat. No. 9,797,889 (herein incorporated by reference in its entirety) describes development and use of a complementation system comprising a $β_{1-9}$-like polypeptide and a $β_{10}$-like peptide (the actual polypeptide and peptide sequences in U.S. Pat. No. 9,797,889 differ from the corresponding sequences in NANOLUC and wild-type native OgLuc).

In experiments conducted during development of embodiments herein, a $β_{1-9}$-like polypeptide was further split by removal of the 19 strand. The remaining portion (a $β_{1-8}$-like polypeptide) is referred to herein as LgTrip 2098 (SEQ ID NO: 17; or SEQ ID NO: 31 (with His tag)). Experiments attempted to reconstitute a luminescent complex from LgTrip and two peptides corresponding to the 19 (SmTrip9 pep245; SEQ ID NO: 23) and β10 (SmTrip10 pep86; HiBit, a β10 sequence optimized for use in a high affinity bipartite system; SEQ ID NO: 15) strands. Experiments demonstrated that LgTrip 2098 (SEQ ID NO: 17; or SEQ ID NO: 31 (with His tag)) expressed poorly in E. coli, was unstable, and was susceptible to surface inactivation. Experiments were conducted during development of embodiments herein to develop artificial variants that exhibit one or more (e.g., all) of enhanced stability, enhanced expression, enhanced activity, enhanced molecular interactions, etc., and is capable of being used in a system to reconstitute a bioluminescent complex with peptides corresponding to the β9 (e.g., β9-like peptides (e.g., SmTrip9 pep245; SEQ ID NO: 23)) and β10 (e.g., β10-like peptides (e.g., SmTrip10 pep86; HiBiT; SEQ ID NO: 25)) strands. Experiments conducted during development of embodiments herein demonstrate, for example, that LgTrip 3092 (SEQ ID NO: 19) or LgTrip 3546 (SEQ ID NO: 51) are capable of forming a luminescent complex with suitable β9-like (e.g., SmTrip9 pep245; SEQ ID NO: 23) and β10-like (e.g., SmTrip10 pep86; HiBiT; SEQ ID NO: 25) peptides. Experiments were conducted during development of embodiments herein to develop artificial polypeptide components (e.g., SEQ ID NOs: 19, 21, 39, 41, 43, 45, 47, 49, 51, 53, 55, 57, 59, 61, 63, 65, 67, 69, 71, 73, 75, 77, 79, 81, 83, 85, 87, 89, 91, 93, 95, 97, 99, 101, 103, 105, 107, 109, 111, 113, 115, 117, 119, 121, 123, 125, 127, 129, 131, and additional variants thereof) and peptide tags (e.g., the peptides listed in Table 1 and additional variants thereof) with enhanced characteristics for luminescent complex reconstitution.

Further experiments conducted during development of embodiments herein demonstrate that NANOLUC-based bioluminescent complexes can be formed using constructs comprising other polypeptide components (e.g., $β_{1-5}$-like, $β_{1-6}$-like, $β_{1-7}$-like, etc.) and corresponding combinations of complimentary peptides (e.g., $β_6$-like, $β_7$-like, $β_8$-like, $β_9$-like, $β_{10}$-like), dipeptides (e.g., $β_{6-7}$-like, $β_{7-8}$-like, $β_{8-9}$-like, $β_{9-10}$-like), tripeptides (e.g., $β_{6-8}$-like, $β_{7-9}$-like, $β_{8-10}$-like), polypeptides (e.g., $β_{6-10}$-like, $β_{6-9}$-like, $β_{7-10}$-like, etc.) derived from the NANOLUC-based, NanoBiT®-based, and NanoTrip™-based systems, polypeptides, and peptide described herein. The experiments conducted during development of embodiments herein demonstrate the formation of a bioluminescent complex from two or more (e.g., 2, 3, 4, 5, etc.) peptide and polypeptide components that collectively comprise the full length of a luciferase construct (e.g., a full length luciferase polypeptide comprising 40% or greater (e.g., 40%, 45%, 50%, 55%, 60%, 65%, 70%, 75%, 80%, 85%, 90%, 95%, 100%, or ranges therebetween) sequence identity with SEQ ID NO: 788 or 789).

In some embodiments, provided herein are compositions and methods for the assembly of a bioluminescent complex from two peptide tags (e.g., p9-like (e.g., SmTrip9) and β10-like (e.g., SmTrip10) peptides) and a polypeptide component (e.g., $β_{1-8}$-like (e.g., LgTrip) polypeptide).

In some embodiments, provided herein are compositions and methods for the assembly of a bioluminescent complex from a polypeptide component (e.g., a $β_{1-5}$-like, $β_{1-6}$-like, $β_{1-7}$-like, or $β_{1-8}$-like polypeptide), and complementary peptide(s) (e.g., $β_6$-like, $β_7$-like, $β_8$-like, $β_9$-like, $β_{10}$-like), dipeptide(s) (e.g., $β_{6-7}$-like, $β_{7-8}$-like, $β_{8-9}$-like, $β_{9-10}$-like), tripeptide (e.g., $β_{6-8}$-like, $β_{7-9}$-like, $β_{8-10}$-like), and/or polypeptides (e.g., $β_{6-10}$-like, $β_{6-9}$-like, $β_{7-10}$-like, etc.).

In some embodiments, one or more (e.g., two, three, four, five, etc.) of the peptide tags and the polypeptide component are not fragments of a preexisting protein (e.g., are not structurally-complementary subsequences of a known polypeptide sequence). However, in other embodiments, one or more of the peptide tags and the polypeptide component may be fragments of a known or existing protein, polypeptide, or peptide. In certain embodiments, the bioluminescent activity of the polypeptide component (of the bioluminescent complex) is enhanced (e.g., 2-fold, 3-fold, 4-fold, 5-fold, 10-fold, $10^2$-fold, $10^3$-fold, $10^4$-fold, $10^5$-fold, $10^6$-fold, or more) via structural complementation with the two peptide tags. In some embodiments, provided herein are peptide (peptide tags)/polypeptide elements that are capable of assembling into a bioluminescent complex for the purpose of, for example, detecting and monitoring molecular interactions (e.g., protein-protein, protein-DNA, protein-RNA interactions, RNA-DNA, protein-small molecule, RNA-small-molecule, DNA-DNA, RNA-RNA, PNA-DNA, PNA-RNA, etc.). In some embodiments, the peptide/dipeptide/tripeptide tags (e.g., β6-like, β7-like, β8-like, β9-like (e.g., SmTrip9), and/or β10-like (e.g., SmTrip10) peptides, and/or dipeptides and tripeptide thereof) are fused, or otherwise linked to interaction elements. In particular embodiments, the peptide/dipeptide/tripeptide tags and polypeptide components, when for the purpose of detecting/monitoring molecular interactions, do not form a complete bioluminescent complex without facilitation by the interaction between interaction elements. However, upon interaction (e.g., binding) of the interaction elements to each other (or to a target molecule or complex), formation of the bioluminescent complex is facilitated. In some embodiments, the bioluminescent signal from the bioluminescent complex (or the capacity to produce such a signal in the presence of substrate) serves as a reporter for the formation of a complex by the interaction elements. If an interaction complex is formed, then a bioluminescent complex is formed, and a bioluminescent signal is detected/measured/monitored (e.g., in the presence of substrate). If an interaction complex fails to form (e.g., due to unfavorable conditions, due to unstable interaction between the interaction elements, due to incompatible interaction elements), then a bioluminescent complex does not form, and a bioluminescent signal is not produced (e.g., in the presence of substrate). In some embodiments, the bioluminescent signal from the bioluminescent complex (or the capacity to produce such a signal in the presence of substrate) serves as a reporter for the binding of the interaction elements to a target. If target-binding occurs, then a bioluminescent complex is formed and a bioluminescent signal is detected/measured/monitored (e.g., in the presence of substrate). If target-binding fails to occur (e.g., due to unfavorable conditions, due to unstable interaction between an interaction element and target, due to the absence of target, etc.), then a bioluminescent complex does not form and a bioluminescent signal is not produced.

In certain embodiments, interaction elements are two molecules of interest (e.g., protein(s) of interest, small molecule(s) of interest, etc.). For example, assays can be performed to detect the interaction of two molecules of interest by tethering each one to separate peptide/dipeptide/tripeptide tag (e.g., $\beta$6-like, $\beta$7-like, $\beta$8-like, $\beta$9-like (e.g., SmTrip9), and/or $\beta$10-like (e.g., SmTrip10) peptides, and/or dipeptides and tripeptides thereof). If the molecules of interest interact (e.g., transiently interact, stably interact, etc.), the peptide/dipeptide/tripeptide tags are brought into close proximity in a suitable conformation, and a bioluminescent complex is formed between the peptide/dipeptide/tripeptide tags and the polypeptide component of the bioluminescent complex (and bioluminescent signal is produced/detected (e.g., in the presence of substrate)).

In the absence of an interaction between the molecules of interest, the peptide/dipeptide/tripeptide tags are not brought into close proximity and/or arranged in an orientation to facilitate complex formation with the polypeptide component of the bioluminescent complex, the bioluminescent complex is not formed, and a bioluminescent signal is not produced (in the presence of substrate). Such embodiments can be used to study the effect of inhibitors on complex formation, the effect of mutations on complex formation, the effect of conditions (e.g., temperature, pH, etc.) on complex formation, the interaction of a small molecule (e.g., potential therapeutic) with a target molecule, etc.

In some embodiments, peptide/dipeptide/tripeptide tags (e.g., $\beta$6-like, $\beta$7-like, $\beta$8-like, $\beta$9-like (e.g., SmTrip9), and/or $\beta$10-like (e.g., SmTrip10) peptides, and/or dipeptides and tripeptide thereof) and a polypeptide component (e.g., $\beta$1-5-like, $\beta$1-6-like, $\beta$1-7-like, $\beta$1-8-like (e.g., LgTrip) polypeptide) are provided that are capable of assembling into a bioluminescent complex without facilitation by interaction elements. In such embodiments, a bioluminescent complex will form when the peptide/dipeptide/tripeptide tags and polypeptide component are together within the same sample, subcellular compartment, cell, tissue, etc. (e.g., co-localized). In some embodiments, provided herein peptide/dipeptide/tripeptide (tags)/polypeptide elements that are capable of assembling into a bioluminescent complex for use in detecting and monitoring co-localization (e.g., without molecular interaction) of molecular elements (e.g., protein(s), nucleic acid(s), small molecule(s), lipid, carbohydrate, cellular structure, etc.). In some embodiments, a bioluminescent complex is formed from peptide/dipeptide/tripeptide tags and a polypeptide component that collectively span a full $\beta$1-like to $\beta$10-like sequence. In some embodiments, the peptide/dipeptide/tripeptide tags are fused or otherwise linked to co-localization elements. In particular embodiments, particularly for the purpose of detecting/monitoring co-localization (e.g., without molecular interaction), the peptide/dipeptide/tripeptide tags and polypeptide components are capable of forming a bioluminescent complex without facilitation (e.g., without interaction elements). Upon co-localization (e.g., within the same cell, on the same surface, with the same cellular compartment, within the same tissue, etc.) of the co-localization elements (e.g., fused to the peptide/dipeptide/tripeptide tags), formation of the bioluminescent complex (from the peptide/dipeptide/tripeptide tags and the polypeptide component), with or without interaction of the co-localization elements, is facilitated. In some embodiments, the bioluminescent signal from the bioluminescent complex (or the capacity to produce such a signal in the presence of substrate) serves as a reporter for co-localization of the co-localization elements. If the co-localization elements co-localize, then a bioluminescent complex of the polypeptide component and the peptide/dipeptide/tripeptide tags fused to the co-localization elements is formed, and a bioluminescent signal is detected/measured/monitored (e.g., in the presence of substrate). If the co-localization elements do not co-localize, then a bioluminescent complex does not form, and a bioluminescent signal is not produced (e.g., in the presence of substrate).

In certain embodiments, the co-localization pair comprises two molecules of interest (e.g., protein(s) of interest, small molecule(s) of interest, etc.). For example, assays can be performed to detect the co-localization (e.g., within a cell, within a cellular compartment, within a tissue, etc.) of two molecules of interest by tethering each one to a separate dipeptide/tripeptide tags (e.g., $\beta$6-like, $\beta$7-like, $\beta$8-like, $\beta$9-like (e.g., SmTrip9), and/or $\beta$10-like (e.g., SmTrip10) peptides, and/or dipeptides and tripeptides thereof). If the molecules of interest co-localize, the peptide tags are brought into close proximity in a suitable conformation, and a bioluminescent complex is formed with the polypeptide component polypeptide component (e.g., $\beta$1-5-like, $\beta$1-6-like, $\beta$1-7-like, $\beta$1-8-like (e.g., LgTrip) polypeptide), and bioluminescent signal is produced/detected (e.g., in the presence of substrate). In the absence of co-localization of the molecules of interest, the polypeptide components and peptide/dipeptide/tripeptide tags tags do not interact to form a complex, and a bioluminescent signal is not produced (e.g., in the presence of substrate). Such embodiments can be used to study co-localization of molecules of interest under various conditions.

In some embodiments, systems, assays, and devices comprising dipeptide/tripeptide tags tags e.g., $\beta$6-like, $\beta$7-like, $\beta$8-like, $\beta$9-like (e.g., SmTrip9), and/or $\beta$10-like (e.g., SmTrip10) peptides, and/or dipeptides and tripeptides thereof) and a polypeptide component (e.g., $\beta$1-5-like, $\beta$1-6-like, $\beta$1-7-like, $\beta$1-8-like (e.g., LgTrip) polypeptide) are provided for the detection of an analyte (e.g., small molecule, peptide, protein, antibody, nucleic acid, etc.) in a sample. In some embodiments, peptide/dipeptide/tripeptide tags are tethered or fused with detection/binding agents (e.g., binding moiety, binding sequence, etc.) that recognize the target analyte, target analytes, secondary analytes that are bound by the target analyte, secondary binding agents that bind to primary binding agents, etc. In some embodiments, various combinations of peptide/dipeptide/tripeptide tags tethered/fused to the aforementioned detection/binding agents are used in assays and devices for the detection/quantification/identification of analytes in a sample. Exemplary systems that find use in assays and devices are depicted in, for example, FIGS. 51-56 and described herein.

In some embodiments, provided herein are compositions and methods for the assembly of a bioluminescent complex from a dipeptide (e.g., a β9/β10-like dipeptide) and a polypeptide component (e.g., $\beta_{1-8}$-like (e.g., LgTrip) polypeptide). In some embodiments, the dipeptide and the polypeptide component are not fragments of a preexisting protein (e.g., are not structurally-complementary subsequences of a known polypeptide sequence). However, in other embodiments, the dipeptide and/or the polypeptide component may be fragments of a known or existing protein, polypeptide, or peptide. In certain embodiments, the bioluminescent activity of the polypeptide component (of the bioluminescent complex) is enhanced (e.g., 2-fold, 3-fold, 4-fold, 5-fold, 10-fold, $10^2$-fold, $10^3$-fold, $10^4$-fold, $10^5$-fold, $10^6$-fold, or more) via structural complementation with the dipeptide. In some embodiments, a $\beta_{1-8}$-like polypeptide exhibits lower background luminescence than a $\beta_{1-9}$-like polypeptide. In some embodiments, a $\beta_{1-8}$-like polypeptide exhibits increased thermal and chemical stability compared to a $\beta_{1-9}$-like polypeptide.

In some embodiments, provided herein are bioluminescent complexes, including but not limited to those comprising any of the following combinations of peptide, dipeptide, tripeptide, and polypeptide components:

β1-5-like polypeptide+β6-like peptide+β7-like peptide+β8-like peptide+β9-like peptide+β10-like peptide;
$\beta_{1-5}$-like polypeptide+$\beta_6$-like peptide+β7-like peptide+β8-like peptide+β9/10-like dipeptide;
β1-5-like polypeptide+β6-like peptide+β7/8-like dipeptide+β9/10-like dipeptide;
β1-5-like polypeptide+β6/7/8-like tripeptide+β9/10-like dipeptide;
β1-5-like polypeptide+β6-like peptide+β7/8/9-like tripeptide+β10-like peptide;
$\beta_{1-6}$-like polypeptide+β7-like peptide+β8-like peptide+β9-like peptide+β10-like peptide;
β1-6-like polypeptide+β7-like peptide+β8-like peptide+β9/10-like dipeptide;
β1-6-like polypeptide+β7/8-like dipeptide+β9/10-like dipeptide;
β1-6-like polypeptide+β6/7/8-like dipeptide+β9-like peptide+β10-like peptide;
β1-6-like polypeptide+β7/8/9-like tripeptide+β10-like peptide;
β1-7-like polypeptide+β8-like peptide+β9-like peptide+β10-like peptide;
β1-7-like polypeptide+β8-like peptide+β9/10-like dipeptide;
β1-7-like polypeptide+β8/9-like dipeptide+β10-like peptide;
β1-7-like polypeptide+β8/9/10-like tripeptide;
β1-8-like polypeptide+β9-like peptide+β10-like peptide;
β1-8-like polypeptide+β9/10-like dipeptide;
β1-5-like polypeptide+β6-10-like polypeptide;
β1-5-like polypeptide+β6-9-like polypeptide+β10-like peptide; and
β1-5-like polypeptide+$\beta_{7-10}$-like polypeptide+β6-like peptide.

The above combinations are not limiting and other combinations of peptide, dipeptide, tripeptide, and polypeptide components are within the scope herein.

In some embodiments, a β1-5-like polypeptide comprises positions 1-102 of SEQ ID NO: 788. In some embodiments, a β1-6-like polypeptide comprises positions 1-124 of SEQ ID NO: 788. In some embodiments, a β1-7-like polypeptide comprises positions 1-133 of SEQ ID NO: 788. In some embodiments, a β1-8-like polypeptide comprises positions 1-148 of SEQ ID NO: 788.

In some embodiments, a set of β5-10-like peptides/dipeptide/tripeptides/polypeptide collectively comprise positions 103-170 of SEQ ID NO: 788 or 789. In some embodiments, a set of β6-10-like peptides/dipeptide/tripeptides/polypeptide collectively comprise positions 125-170 of SEQ ID NO: 788 or 789. In some embodiments, a set of β7-10-like peptides/dipeptide/tripeptides/polypeptide collectively comprise positions 134-170 of SEQ ID NO: 788 or 789. In some embodiments, a set of β8-10-like peptides/dipeptide/tripeptides/polypeptide collectively comprise positions 149-170 of SEQ ID NO: 788 or 789.

In some embodiments, one or more components of a bioluminescent complex span partial beta strands of the base luciferases (e.g., OgLuc, NANOLUC, SEQ ID NO: 788, SEQ ID NO: 789, etc.) described herein. The separations between peptide, dipeptide, tripeptide, and polypeptide components may reside at the split points between the beta strands or may appear at a position −1, −2, −3, −4, −5, +1, +2, +3, +4, +5, or more from the split points identified by the sequences herein. In some embodiments, peptide, dipeptide, tripeptide, and polypeptide components that span the full sequence of a base luciferases (e.g., OgLuc, NANOLUC, SEQ ID NO: 788, SEQ ID NO: 789, etc.) described herein are capable of forming a bioluminescent complex, even if the split points for the components are not between the beta strands.

For example, a split site between β5 and β6 may occur between positions 102 and 103 of SEQ ID NO: 788, or in some embodiments such a split site may occur at a position up to 5 residues before or after that position (e.g., after position 96, 97, 98, 99, 100, 101, 103, 104, 105, 106, 107). In some embodiments, a split site between β6 and β7 may occur between positions 124 and 125 of SEQ ID NO: 788, or in some embodiments such a split site may occur at a position up to 5 residues before or after that position (e.g., after position 118, 119, 120, 121, 122, 123, 125, 126, 127, 128, 129). In some embodiments, a split site between β7 and β8 may occur between positions 133 and 134 of SEQ ID NO: 788, or in some embodiments such a split site may occur at a position up to 5 residues before or after that position (e.g., after position 127, 128, 129, 130, 131, 132, 134, 135, 136, 137, 138). In some embodiments, a split site between β8 and β9 may occur between positions 148 and 149 of SEQ ID NO: 788, or in some embodiments such a split site may occur at a position up to 5 residues before or after that position (e.g., after position 142, 143, 144, 145, 146, 147, 149, 150, 151, 152, 153).

In some embodiments, two peptide, dipeptide, tripeptide, and polypeptide components that are sequentially adjacent within the base luciferase (e.g., OgLuc, NANOLUC, SEQ ID NO: 788, SEQ ID NO: 789, etc.) sequence comprise all of the amino acids of that corresponding portion of the base sequence. In some embodiments, one or more (e.g., 1, 2, 3, 4, 5, or more) amino acids adjacent to the split point in the base sequence are absent from the corresponding peptide, dipeptide, tripeptide, and/or polypeptide components.

In some embodiments, provided herein are peptides comprising 40% or greater (e.g., 40%, 45%, 50%, 55%, 60%, 65%, 70%, 75%, 80%, 85%, 90%, 95%, or 100%) sequence identity with one of the following:

β$_6$-like—GVTPNKLNYFGRPYEGIAVFDG (SEQ ID NO: 802);
β$_7$-like—KKITTTGTL (SEQ ID NO: 803
β8-like—WNGNKIIDERLITPD (SEQ ID NO: 804
β9-like—GSMLFRVTINS (SEQ ID NO: 805
β10-like (Hi affinity)—VSGWRLFKKIS (SEQ ID NO: 806 and
β10-like (Lo affinity)—VTGYRLFEEIL (SEQ ID NO: 807

In some embodiments, provided herein are dipeptides comprising 40% or greater (e.g., 40%, 45%, 50%, 55%, 60%, 65%, 70%, 75%, 80%, 85%, 90%, 95%, or 100%) sequence identity with one of the following:

β6/7-like—GVTPNKLNYFGRPYEGIAVFDGKKIT-TTGTL (SEQ ID NO: 808)
β7/8-like—KKITTTGTLWNGNKIIDERLITPD (SEQ ID NO: 809);
β8/9-like—WNGNKIIDERLITPDGSMLFRVTINS (SEQ ID NO: 810);
β9/10-like (Hi affinity)—GSMLFRVTINSVSGWRLFK-KIS (SEQ ID NO: 811); and
β9/10-like (Lo affinity)—GSMLFRVTINSVTGYRL-FEEIL (SEQ ID NO: 812).

In some embodiments, provided herein are tridipeptides comprising 40% or greater (e.g., 40%, 45%, 50%, 55%, 60%, 65%, 70%, 75%, 80%, 85%, 90%, 95%, or 100%) sequence identity with one of the following:

β6/7/8-like —GVTPNKLNYFGRPYEGIAVFDGKKIT-TTGTLWNGNKIIDERLITPD (SEQ ID NO: 813);
β7/8/9-like—KKITTTGTLWNGNKIIDER-LITPDGSMLFRVTINS (SEQ ID NO: 814);
B8/9/10-like (Hi affinity)—WNGNKIIDER-LITPDGSMLFRVTINSVSGWRLFKKIS (SEQ ID NO: 815); and
B8/9/10-like (Lo affinity)—WNGNKIIDER-LITPDGSMLFRVTINSVTGYRLFEEIL (SEQ ID NO: 816).

In some embodiments, provided herein are polypeptide comprising 40% or greater (e.g., 40%, 45%, 50%, 55%, 60%, 65%, 70%, 75%, 80%, 85%, 90%, 95%, or 100%) sequence identity with one of the following:

β$_{1-5}$-like
—MVFTLDDFVGDWEQTAAYNLDQVLEQGGVS SLLQNLAVSVTPIMRIVRSGENALKI DIHVIIPYEGLSADQMAQIEEVFKVVYPVD-DHHFKVILPYGTLVID (SEQ ID NO: 790);
β$_{6-10}$-like (Hi affinity)—GVTPNKLNYFGRPYEGIA-VFDGKKITTTGTLWNGNKIIDERLITPDGSML-FRVTINSVS GWRLFKKIS (SEQ ID NO: 794);
β$_{6-10}$-like (Lo affinity)—GVTPNKLNYFGRPYEGIA-VFDGKKITTTGTLWNGNKIIDERLITPDGSML-FRVTINSV TGYRLFEEIL (SEQ ID NO: 798);
β$_{6-9}$-like —GVTPNKLNYFGRPYEGIAVFDGKKIT-TTGTLWNGNKIIDERLITPDGSMLFRVTINS (SEQ ID NO: 829);
β7-10-like (Hi affinity)—KKITTTGTLWNGNKIIDER-LITPDGSMLFRVTINSVSGWRLFKKIS (SEQ ID NO: 795); and
β7-10-like (Lo affinity)—KKITTTGTLWNGNKI-IDERLITPDGSMLFRVTINSVTGYRLFEEIL (SEQ ID NO: 799).

In some embodiments, a polypeptide component (e.g., of a set of peptides/polypeptides, or a bioluminescent complex, etc.) comprises 40% or greater (e.g., 40%, 45%, 50%, 55%, 60%, 65%, 70%, 75%, 80%, 85%, 90%, 95%, or 100%) sequence identity with one of SEQ ID NOS: 788, 789, 790, 791, 792, and 793.

In some embodiments, peptide/dipeptide/tripeptide components (e.g., tags) (e.g., of a set of peptides/polypeptides, or a bioluminescent complex, etc.) collectively comprise 40% or greater (e.g., 40%, 45%, 50%, 55%, 60%, 65%, 70%, 75%, 80%, 85%, 90%, 95%, or 100%) sequence identity with one of SEQ ID NOS: 794, 795, 796, 797, 798, 799, 800, and 801.

In some embodiments, provided herein are sets of components and complexes of the peptides, dipeptides, tripeptides, and polypeptides listed above. In particular embodiments, sets of components are selected that span all ten of the beta strands of a base luciferase sequence.

In some embodiments, the interaction, co-localization, detection, and other methods, assays, and technologies described for use with the two-peptide tag systems herein (e.g., β9-like (e.g., SmTrip9) peptide, β10-like (e.g., SmTrip10) peptides and polypeptide component ((e.g., β1-8-like (e.g., LgTrip) polypeptide)), also find use with the dipeptide systems described herein (e.g., β9/β10-like dipeptide and polypeptide component). In some embodiments, a dipeptide has high affinity for a polypeptide component; in such embodiments, a bioluminescent complex forms when the dipeptide and polypeptide component are brought into contact (e.g., co-localize, are added to the sample sample, etc.) without facilitation. In some embodiments, a dipeptide has low affinity for a polypeptide component; in such embodiments, a bioluminescent complex will not form when the dipeptide and polypeptide component are brought into contact (e.g., co-localize, are added to the sample sample, etc.) without facilitation. Like the two-peptide tag systems herein (e.g., β9-like (e.g., SmTrip9) peptide, β10-like (e.g., SmTrip10) peptides and polypeptide component (e.g., β1-8-like (e.g., LgTrip) polypeptide)), dipeptide/polypeptide pairs of varying affinities may be selected for different applications. In some embodiments, systems, methods, and assays for two-component complementation systems are described in U.S. Pat. No. 9,797,890 (herein incorporated by reference in its entirety), and all such systems, methods, and assays find use with the dipeptide/polypeptide systems described herein.

In some embodiments, the interaction, co-localization, detection, and other methods, assays, and technologies described for use with the two-peptide tag systems herein (e.g., β9-like (e.g., SmTrip9) peptide, β10-like (e.g., SmTrip10) peptides and polypeptide component ((e.g., β1-8-like (e.g., LgTrip) polypeptide)), also find use with systems comprising any suitable combination for peptides, dipeptides, trippeptides, and polypeptides, as described herein. In some embodiments, the components have high affinity for one another; in such embodiments, a bioluminescent complex forms when the components are brought into contact (e.g., co-localize, are added to the sample sample, etc.) without facilitation. In some embodiments, one or more of the components have low affinity for one or more of the other components; in such embodiments, a bioluminescent complex will not form when the components are brought into contact (e.g., co-localize, are added to the sample sample, etc.) without facilitation. Like the two-peptide tag systems herein (e.g., β9-like (e.g., SmTrip9) peptide, β10-like (e.g., SmTrip10) peptides and polypeptide component (e.g., β1-8-like (e.g., LgTrip) polypeptide)), the other systems described herein may be provided with varying affinities for different applications. In some embodiments, systems, methods, and assays for two-component complementation systems are described in U.S. Pat. No. 9,797,890 (herein incorporated by reference in its entirety), and all such systems, methods, and assays find use with the various peptide, dipeptide, tripeptide, and polypeptide systems described herein.

In some embodiments, provided herein are complementary panels of interchangeable peptide/dipeptide/tripeptide tags (e.g., β6-like, β7-like, β8-like, β9-like (e.g., SmTrip9), and/or β10-like (e.g., SmTrip10) peptides, and/or dipeptides and tripeptides thereof) and polypeptide components (e.g., β1-5-like, β1-6-like, β1-7-like, β1-8-like (e.g., LgTrip) polypeptide) that have variable affinities and luminescence upon formation of bioluminescent complexes therefrom (e.g., a high-affinity/high-luminescence, a moderate-affinity/high-luminescence, a low-affinity/moderate-luminescence, etc.). Utilizing different combinations of peptide/dipeptide/tripeptide tags and polypeptide components provides an adaptable system comprising various sets ranging from lower to higher affinities, luminescence, expression level, stability, solubility, and other variable characteristics. This adaptability allows the detection/monitoring/identification/quantification of analytes, molecular interactions, co-localization, and/or other characteristics to be fine-tuned to the specific molecule(s) of interest and/or conditions to be studied and expands the range of molecular interactions and/or co-localizations that can be detected/monitored/identified/quantified to include interactions with very high or low affinities. Further provided herein are methods by which non-luminescent elements and panels of non-luminescent elements are developed and tested.

In some embodiments, due to the small size of the tags (e.g., peptide tags) herein (e.g., compared to larger polypeptides and proteins), they are resistant to denaturation (they have no tertiary structure required for function).

In some embodiments, peptide/dipeptide/tripeptide tags and a polypeptide components may be selected based on the molecules or proteins of interest to be studied. In some embodiments, different peptide/dipeptide/tripeptide tags (e.g., β6-like, β7-like, β8-like, β9-like (e.g., SmTrip9), and/or β10-like (e.g., SmTrip10) peptides, and/or dipeptides and tripeptides thereof) and polypeptide components (e.g., β1-5-like, β1-6-like, β1-7-like, β1-8-like (e.g., LgTrip) polypeptide) may require different strength, duration, and/or stability of an interaction complex (e.g., complex of interaction elements) to result in bioluminescent complex formation. In some embodiments, a highly stable interaction complex is required to produce a detectable bioluminescent signal (e.g., in the presence of a substrate). In other embodiments, even a weak or transient interaction complex results in bioluminescent complex formation. In still other embodiments, a bioluminescent complex will form in the absence of an interaction complex as long as the peptide/dipeptide/tripeptide tags and polypeptide component are co-localized. In some embodiments, the strength or extent of an interaction complex is directly proportional to the strength of the resulting bioluminescent signal. Some peptide/dipeptide/tripeptide tags/polypeptide component sets produce a detectable signal when combined with an interaction complex with a high millimolar dissociation constant (e.g., $K_d > 100$ mM). Other peptide/dipeptide/tripeptide tags/polypeptide component sets require an interaction pair with a low millimolar (e.g., $K_d < 100$ mM), micromolar (e.g., $K_d < 1$ mM), nanomolar (e.g., $K_d < 1$ μM), or even picomolar (e.g., $K_d < 1$ nM) dissociation constant in order to produce a bioluminescent complex with a detectable signal.

In some embodiments, the peptide/dipeptide/tripeptide tags and/or polypeptide components herein are not fragments of a pre-existing protein (e.g., a pre-existing bioluminescent protein). In some embodiments, none of the peptide/dipeptide/tripeptide tags and polypeptide component used to form a complex are fragments of a pre-existing protein (e.g., the same pre-existing protein, a pre-existing bioluminescent protein, etc.). In some embodiments, neither the peptide tags (e.g., β9-like (e.g., SmTrip9) and β10-like (e.g., SmTrip10) peptides; β9/β10-like dipeptides; etc.) nor polypeptide component (e.g., $β_{1-8}$-like (e.g., LgTrip) polypeptide)) that assemble together to form a bioluminescent complex are fragments of a pre-existing protein (e.g., the same pre-existing protein, a pre-existing bioluminescent protein, etc.). In some embodiments, the peptide/dipeptide/tripeptide tags or polypeptide component of a bioluminescent complex for use in embodiments of the present invention is not a subsequence of a preexisting protein. In some embodiments, non-luminescent elements for use in embodiments described herein do not comprise structurally-complementary subsequences of a preexisting protein.

In some embodiments, the peptide/dipeptide/tripeptide tags (e.g., β6-like, β7-like, 18-like, β9-like (e.g., SmTrip9), and/or β10-like (e.g., SmTrip10) peptides, and/or dipeptides and tripeptides thereof) herein are non-luminescent or substantially non-luminescent in isolation (e.g., in the presence or absence of substrate). In some embodiments, the peptide/dipeptide/tripeptide tags herein are non-luminescent or substantially non-luminescent when associated together, in the absence of the polypeptide component (e.g., β1-5-like, β1-6-like, β1-7-like, β1-8-like (e.g., LgTrip) polypeptide) (e.g., in the presence or absence of substrate). In some embodiments, a polypeptide component is non-luminescent or substantially non-luminescent in isolation (e.g., in the presence or absence of substrate). In some embodiments, a single peptide/dipeptide/tripeptide tags (e.g., β6-like, β7-like, β8-like, β9-like (e.g., SmTrip9), and/or β10-like (e.g., SmTrip10) peptides, and/or dipeptides and tripeptides thereof) and the polypeptide component are non-luminescent or substantially non-luminescent in the absence of the second or third or fourth peptide/dipeptide/tripeptide tag (e.g., in the presence or absence of substrate). In certain embodiments, when placed in suitable conditions (e.g., physiological conditions), multiple peptide/dipeptide/tripeptide tags and a polypeptide component interact to form a bioluminescent complex and produce a bioluminescent signal in the presence of substrate.

In certain embodiments, an interaction element and/or co-localization element and a peptide/dipeptide/tripeptide tag are attached, fused, linked, connected, etc. In typical embodiments, a first peptide/dipeptide/tripeptide tag and a first interaction element (or first co-localization element) are attached to each other, and a second peptide/dipeptide/tripeptide tag and a second interaction element (or second co-localization element) are attached to each other. Attachment of peptide/dipeptide/tripeptide tags to interaction elements (or co-localization elements) may be achieved by any suitable mechanism, chemistry, linker, etc. The interaction elements (or co-localization elements) and peptide/dipeptide/tripeptide tags are typically attached through covalent connection, but non-covalent linking of the two elements is also provided. In some embodiments, the peptide/dipeptide/tripeptide tags and interaction elements (or co-localization elements) are directly connected and, in other embodiments, they are connected by a linker. In some embodiments, the peptide/dipeptide/tripeptide tags and interaction elements (or co-localization elements) are provided as genetic/recombinant fusions. In some embodiments, endogenous tagging with the peptide/dipeptide/tripeptide tags herein (e.g., under endogenous regulatory control), allows for monitoring of normal cellular functions with the tools described herein. For example, a protein of interest may be endogenously tagged (e.g., using CRISPR/Cas9) with a high affinity 39/10-like dipeptide, and then spontaneous complementation with LgTrip (or a variant thereof) is monitored in a cell, animal, lysate, etc. In other embodiments, the peptide tags and interaction elements (or co-localization elements) are connected by chemical modification/conjugation, such as by Native chemical ligation, Staudinger ligation, "traceless" Staudinger ligation, amide coupling, methods that employ activated esters, methods to target lysine, tyrosine and cysteine residues, imine bond formation (with and without ortho-boronic acid), boronic acid/diol interactions, disulfide bond formation, copper/copper free azide, diazo, and tetrazine "click" chemistry, UV promoted thiolene conjugation, diazirine photolabeling, Diels-Alder cycloaddition, metathesis reaction, Suzuki cross-coupling, thiazolidine (Step-4) coupling, streptavidin/biotin complementation, HaloTag®/ chloroalkane substrate complementation, etc. In some embodiments, peptide/dipeptide/tripeptide tags and interaction elements (or co-localization elements) are produced synthetically (e.g., solid-state synthesis, solution-phase synthesis, etc.). In some embodiments, interaction elements (or co-localization elements) are produced (e.g., synthetically or recombinantly) or obtained (e.g., from crude lysate, extracted proteins, purified proteins, etc.) by any suitable means.

In some embodiments, in which the interaction element (or co-localization element) is a peptide or polypeptide, a peptide/dipeptide/tripeptide tag (e.g., β6-like, β7-like, β8-like, β9-like (e.g., SmTrip9), and/or β10-like (e.g., SmTrip10) peptides, and/or dipeptides and tripeptides thereof) and an interaction element (or co-localization element) are contained within a single amino acid chain. In some embodiments, a single amino acid chain comprises, consists of, or consists essentially of a peptide/dipeptide/ tripeptide tag and an interaction element (or co-localization element). In some embodiments, a single amino acid chain comprises, consists of, or consists essentially of a peptide/ dipeptide/tripeptide tag, an interaction element (or co-localization element), optionally one or more an N-terminal sequence, a C-terminal sequence, regulatory elements (e.g., promoter, translational start site, etc.), and a linker sequence. In some embodiments, the peptide/dipeptide/tripeptide tag and interaction element (or co-localization element) are contained within a fusion polypeptide. In some embodiments, the first fusion of peptide/dipeptide/tripeptide tag and interaction element (or co-localization element) and the second fusion of peptide/dipeptide/tripeptide tag and interaction element (or co-localization element) are expressed separately; however, in other embodiments, a fusion protein is expressed that comprises or consist of both of the interaction (or co-localization) and peptide/dipeptide/tripeptide tags.

In some embodiments, a first fusion protein comprising a first peptide/dipeptide/tripeptide tag (e.g., β6-like, β7-like, β8-like, β9-like (e.g., SmTrip9), and/or β10-like (e.g., SmTrip10) peptides, and/or dipeptides and tripeptides thereof) and first interaction element as well as a second fusion protein comprising a second peptide/dipeptide/tripeptide tag (e.g., β6-like, β7-like, β8-like, β9-like (e.g., SmTrip9), and/or β10-like (e.g., SmTrip10) peptides, and/or dipeptides and tripeptides thereof) and second interaction element are expressed within the same cells. In some embodiments, a first fusion protein comprising a first peptide/dipeptide/tripeptide tag and first co-localization element as well as a second fusion protein comprising a second peptide/dipeptide/tripeptide tag and second co-localization element are expressed within the same cells. In some embodiments, the first and second fusion proteins are purified and/or isolated from the cells. In some embodiments, the interaction and/or co-localization of the fusion proteins is assayed within the cells. In some embodiments, the interaction and/or co-localization of the fusion proteins is assayed within a lysate of the cells. In other embodiments, first and second fusion proteins are expressed in separate cells and combined (e.g., following purification and/or isolation, following fusion of the cells or portions of the cells, by transfer of a fusion protein from one cell to another, or by secretion of one or more fusion proteins into the extracellular medium) for signal detection. In some embodiments, one or more fusion proteins are expressed in cell lysate (e.g., rabbit reticulocyte lysate) or in a cell-free system. In some embodiments, one or more fusion proteins are expressed from the genome of a virus or other cellular pathogen. In some embodiments, the polypeptide component (e.g., β1-5-like, β1-6-like, β1-7-like, β1-8-like (e.g., LgTrip) polypeptide) and any other peptide/dipeptide/tripeptide components (e.g., β6-like, β7-like, β8-like, β9-like (e.g., SmTrip9), and/or β10-like (e.g., SmTrip10) peptides, and/or dipeptides and tripeptides thereof) for complex formation (with the first and second fusion proteins) is expressed in the same cell or cell lysate as one or both of the tag-containing fusion proteins. In some embodiments, the peptide/dipeptide/tripeptide/polypeptide components for complex formation with the peptide/dipeptide/tripeptide tags (within the first and second fusion proteins) are expressed in a different cell or cell lysate as one or both of the peptide-tag-containing fusion proteins. In some embodiments, the peptide/dipeptide/tripeptide/polypeptide components for complex formation with the peptide/dipeptide/tripeptide tags (within the first and second fusion proteins) is added to a cell, cell lysate, or other sample comprising the peptide-tag-containing fusion proteins.

In some embodiments, the systems (e.g., peptide/dipeptide/tripeptide tags, peptide/dipeptide/tripeptide/polypeptide components, substrates, vectors, etc.) and methods herein find use in the analysis of a sample (e.g., detection/quantification/identification/monitoring of co-localization, a molecular interaction, a target, etc.). In some embodiments, one or more of the components of a system herein are added to and/or provided or expressed within a sample. Suitable samples that may find use in embodiments herein include, but are not limited to: blood, plasma, sera, urine, saliva, cells, cell lysates, tissues, tissue homogenates, purified nucleic acids, stool, vaginal secretions, cerebrospinal fluid, allantoic fluid, water, biofilm, soil, dust, food, beverage, agriculture products, plants, etc.

In certain embodiments, nucleic acids, DNA, RNA, vectors, etc. are provided that encode the peptide/dipeptide/ tripeptide tags (e.g., β6-like, β7-like, β8-like, β9-like (e.g., SmTrip9), and/or β10-like (e.g., SmTrip10) peptides, and/or dipeptides and tripeptides thereof) and a polypeptide components (e.g., β1-5-like, β1-6-like, β1-7-like, β1-8-like (e.g., LgTrip) polypeptide), fusion polypeptides, fusion proteins, etc. described herein. Such nucleic acids and vectors may be used for expression, transformation, transfection, injection, etc.

In some embodiments, a peptide/dipeptide/tripeptide tags (e.g., β6-like, β7-like, β8-like, β9-like (e.g., SmTrip9), and/or β10-like (e.g., SmTrip10) peptides, and/or dipeptides and tripeptides thereof) and interaction, co-localization element, or binding agent are connected by a linker. In some embodiments, a linker connects the signal and interaction or co-localization elements while providing a desired amount of space/distance between the elements. In some embodiments, a linker allows both the signal and interaction elements to form their respective complexes (e.g., luminescent complex and interaction complex) simultaneously. In some embodiments, a linker assists the interaction element in facilitating the formation of a luminescent complex. In some embodiments, when an interaction complex is formed, the linkers that connect each peptide/dipeptide/tripeptide tag to their respective interaction elements position the peptide tags at the proper distance and conformation to form a bioluminescent complex. In some embodiments, an interaction or co-localization element and peptide/dipeptide/tripeptide tag are held in close proximity (e.g., <4 monomer units) by a linker. In some embodiments, a linker provides a desired amount of distance (e.g., 1, 2, 3, 4, 5, 6 . . . 10 . . . 20, or more monomer units) between peptide tags and interaction elements (e.g., to prevent undesirable interactions between peptide/dipeptide/tripeptide tags and interaction or co-localization elements, for steric considerations, to allow proper orientation of non-luminescent element upon formation of interaction complex, to allow propagation of a complex-formation from interaction complex to luminescent complex, etc.). In certain embodiments, a linker provides appropriate attachment chemistry between the peptide/dipeptide/tripeptide tags and interaction elements. A linker may also improve the synthetic process of making the peptide/dipeptide/tripeptide tag and interaction or co-localization element (e.g., allowing them to be synthesized as a single unit, allowing post synthesis connection of the two elements, etc.).

In some embodiments, a linker is any suitable chemical moiety capable of linking, connecting, or tethering a peptide/dipeptide/tripeptide tags (e.g., β6-like, β7-like, β8-like, β9-like (e.g., SmTrip9), and/or β10-like (e.g., SmTrip10) peptides, and/or dipeptides and tripeptides thereof) or polypeptide component (e.g., β1-5-like, β1-6-like, β1-7-like, β1-8-like (e.g., LgTrip) polypeptide) to an interaction element or co-localization element. In some embodiments, a linker is a polymer of one or more repeating or non-repeating monomer units (e.g., nucleic acid, amino acid, carbon-containing polymer, carbon chain, etc.). When a peptide/dipeptide/tripeptide tag and an interaction, co-localization element, or binding agent are part of a fusion protein, a linker (when present) is typically an amino acid chain. When a peptide/dipeptide/tripeptide tag and interaction element, co-localization element, or binding agent are tethered together after the expression of the individual elements, a linker may comprise any chemical moiety with functional (or reactive) groups at either end that are reactive with functional groups on the peptide tag and interaction or co-localization elements, respectively. Any suitable moiety capable of tethering the signal and interaction elements, co-localization element, and/or binding agent may find use as a linker.

A wide variety of linkers may be used. In some embodiments, the linker is a single covalent bond. In some embodiments, the linker comprises a linear or branched, cyclic or heterocyclic, saturated or unsaturated, structure having 1-20 nonhydrogen atoms (e.g., C, N, P, O and S) and is composed of any combination of alkyl, ether, thioether, imine, carboxylic, amine, ester, carboxamide, sulfonamide, hydrazide bonds and aromatic or heteroaromatic bonds. In some embodiments, linkers are longer than 20 non-hydrogen atoms (e.g. 21 non-hydrogen atoms, 25 non-hydrogen atoms, 30 non-hydrogen atoms, 40 non-hydrogen atoms, 50 non-hydrogen atoms, 100 non-hydrogen atoms, etc.) In some embodiments, the linker comprises 1-50 non-hydrogen atoms (in addition to hydrogen atoms) selected from the group of C, N, P, O, and S (e.g. 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40,41, 42, 43, 44, 45, 46, 47, 48, 49, or 50 non-hydrogen atoms).

The scope of embodiments herein is not limited by the types of linkers available. The peptide/dipeptide/tripeptide tags, polypeptide components, and interaction elements, co-localization elements, or binding agents are linked either directly (e.g. linker consists of a single covalent bond) or linked via a suitable linker. Embodiments are not limited to any particular linker group. A variety of linker groups are contemplated, and suitable linkers could comprise, but are not limited to, alkyl groups, methylene carbon chains, ether, polyether, alkyl amide linker, a peptide linker, a modified peptide linker, a Poly(ethylene glycol) (PEG) linker, a streptavidin-biotin or avidin-biotin linker, polyaminoacids (e.g. polylysine), functionalized PEG, polysaccharides, glycosaminoglycans, dendritic polymers (WO93/06868 and by Tomalia et al. in Angew. Chem. Int. Ed. Engl. 29:138-175 (1990), herein incorporated by reference in their entireties), PEG-chelant polymers (W94/08629, WO94/09056 and WO96/26754, herein incorporated by reference in their entireties), oligonucleotide linker, phospholipid derivatives, alkenyl chains, alkynyl chains, disulfide, or a combination thereof. In some embodiments, the linker is cleavable (e.g., enzymatically (e.g., TEV protease site), chemically, photoinduced, etc.

In some embodiments, a peptide/dipeptide/tripeptide tags (e.g., β6-like, β7-like, β8-like, β9-like (e.g., SmTrip9), and/or β10-like (e.g., SmTrip10) peptides, and/or dipeptides and tripeptides thereof) and a polypeptide component (e.g., β1-5-like, β1-6-like, β1-7-like, β1-8-like (e.g., LgTrip) polypeptide), recognition element, interaction element, co-localization element, binding agent, analyte, substrate, etc. is attached (e.g., via any suitable chemistry) to, or contained within, a solid surface or matrix. In some embodiments, one or more system components are attached (e.g., via any suitable chemistry) to, or contained within, a solid surface or matrix and other components are added (e.g., in solution (e.g., in a sample)) to the solid surface or matrix. Suitable solid surfaces include, but are not limited to: beads (e.g., magnetic beads), chips, tubes, plates, particles, membranes, paper, etc. In some embodiments, solid surfaces/matrix is made of any suitable materials, such as: Ahlstrom CytoSep, Cellulose nitrate, Cellulose acetate, Cellulose (e.g., Whatman FTA-DMPK-A, B, and C cards; Whatman ET 3/Chr; Whatman protein saver 903 cards; Whatman Grade 1 filter paper; Whatman FTA Elute; Ahlstrom 226 specimen collection paper; etc.), Noviplex Plasma Prep Cards, Polypropylene membrane, PVDF, Nitrocellulose membrane (Millipore Nitrocellular Hi Flow Plus) Polytetrafluoroethylene film, Mixed cellulose esters, Glass fiber media (e.g., Whatman unifiter plates glass fiber filter membrane, Agilent dried matrix spotting cards, Ahlstrom grade 8950, etc.), Plastic (e.g., Polyester, Polypropylene, Polythersulfene, poly (methacrylate), Acrylic polymers, polytetrafluoreten, etc.), natural and synthetic polymers (e.g., mixture of polymers, co-block polymers, etc.), sugars (e.g., pullulan, trehalose, maltose, sucrose, cellulose, etc.), polyamides (e.g., natural (e.g., wool, silk, etc.), synthetic (e.g., aramids, nylon, etc.), etc.), metals (e.g., aluminum, cadmium, chromium, cobalt, copper, iron, manganese, nickel, platinum, palladium, rhodium, silver, gold, tin, titanium, tungsten, vanadium, zinc, etc.), alloys (e.g., alloys of aluminium (e.g., Al—Li, alumel, duralumin, magnox, zamak, etc.), alloys of iron (e.g., steel, stainless steel, surgical stainless steel, silicon steel, tool steel, cast iron, Spiegeleisen, etc.), alloys of cobalt (e.g., stellite, talonite, etc.), alloys of nickel (e.g., German silver, chromel, mu-metal, monel metal, nichrome, nicrosil, nisil, nitinol, etc.), alloys of copper (e.g., beryllium copper, billon, brass, bronze, phosphor bronze, constantan, cupronickel, bell metal, Devarda's alloy, gilding metal, nickel silver, nordic gold, prince's metal, tumbaga, etc.), alloys of silver (e.g., sterling silver, etc.), alloys of tin (e.g., Britannium, pewter, solder, etc.), alloys of gold (electrum, white gold, etc.), amalgam, etc.), ELISPot plates, Immunoassay plates, Tissue culture plates, etc.

In some embodiments, peptide/dipeptide/tripeptide tags (e.g., β6-like, β7-like, β8-like, β9-like (e.g., SmTrip9), and/or β10-like (e.g., SmTrip10) peptides, and/or dipeptides and tripeptides thereof) and a polypeptide component (e.g., β1-5-like, β1-6-like, β1-7-like, β1-8-like (e.g., LgTrip) polypeptide) of a luminescent complex are provided with less than 100% sequence identity and/or similarity to any portion of an existing luciferase (e.g., a firefly luciferase, a Renilla luciferase, an Oplophorus luciferase, enhanced Oplophorus luciferases as described in U.S. Pat. App. 2010/0281552 and U.S. Pat. App. 2012/0174242, herein incorporated by reference in their entireties). Certain embodiments involve the formation of bioluminescent complexes of peptide/dipeptide/tripeptide tags and a polypeptide component with less than 100% sequence identity with all or a portion (e.g., 8 or more amino acids, less than about 25 amino acids for peptides) of SEQ ID NO: 1 (e.g., complete wild type Oplophorus luciferase sequence) and/or SEQ ID NO: 3 (e.g., complete NANOLUC sequence). Certain embodiments involve the formation of bioluminescent complexes from peptide/dipeptide/tripeptide tags and a polypeptide component with less than 100%, but more than 40% (e.g., >40%, >45%, >50%, >55%, >60%, >65%, >70%, >75%, >80%, >85%, >90%, >95%, >98%, >99%) sequence identity with all or a portion (e.g., 8 or more amino acids, less than about 25 amino acids for peptides) of SEQ ID NO: 1 (e.g., complete wild type Oplophorus luciferase sequence) and/or SEQ ID NO: 3 (e.g., complete NANOLUC sequence). In some embodiments, peptide/dipeptide/tripeptide tags and a polypeptide component are provided with less than 100% sequence similarity with a portion (e.g., 8 or more amino acids, less than about 25 amino acids for peptides) of SEQ ID NO: 1 (e.g., complete wild type Oplophorus luciferase sequence) and/or SEQ ID NO: 3 (e.g., complete NANOLUC sequence). In some embodiments, peptide/dipeptide/tripeptide tags and a polypeptide component are provided with less than 100%, but more than 40% (e.g., >40%, >45%, >50%, >55%, >60%, >65%, >70%, >75%, >80%, >85%, >90%, >95%, >98%, >99%) sequence similarity with a portion (e.g., 8 or more amino acids, less than about 25 amino acids for peptides) of SEQ ID NO: 1 (e.g., complete wild type Oplophorus luciferase sequence) and/or SEQ ID NO: 3 (e.g., complete NANOLUC sequence). In some embodiments, peptide/dipeptide/tripeptide tags are provided that have less than 100% sequence identity and/or similarity with about a 25 amino acid or less portion of SEQ ID NO: 1 (e.g., complete wild type Oplophorus luciferase sequence) and/or SEQ ID NO: 3 (e.g., complete NANOLUC sequence), wherein two of such peptides form a bioluminescent complex when combined under appropriate conditions (e.g., stabilized by an interaction pair, brought into proximity by co-localization elements, etc.) with a polypeptide component having less than 100%, but more than 40% (e.g., >40%, >45%, >50%, >55%, >60%, >65%, >70%, >75%, >80%, >85%, >90%, >95%, >98%, >99%) sequence identity and/or similarity with another portion SEQ ID NO: 1 (e.g., complete wild type Oplophorus luciferase sequence) and/or SEQ ID NO: 3 (e.g., complete NANOLUC sequence). In some embodiments, peptide/dipeptide/tripeptide tags are provided that have less than 100% sequence identity and/or similarity with about a 25 amino acid or less portion of SEQ ID NO: 1 (e.g., complete wild type Oplophorus luciferase sequence) and/or SEQ ID NO: 3 (e.g., complete NANOLUC sequence), wherein a pair of such peptide tags form a bioluminescent complex when combined under appropriate conditions (e.g., stabilized by an interaction pair, brought into proximity by co-localization elements, etc.) with a polypeptide component having less than 100%, but more than 40% (e.g., >40%, >45%, >50%, >55%, >60%, >65%, >70%, >75%, >80%, >85%, >90%, >95%, >98%, >99%) sequence identity and/or similarity with another portion SEQ ID NO: 1 (e.g., complete wild type Oplophorus luciferase sequence) and/or SEQ ID NO: 3 (e.g., complete NANOLUC sequence). In some embodiments, peptide/dipeptide/tripeptide tags are provided that have less than 100%, but more than 40% (e.g., >40%, >45%, >50%, >55%, >60%, >65%, >70%, >75%, >80%, >85%, >90%, >95%, >98%, >99%) sequence identity and/or similarity with about a 25 amino acid or less portion of SEQ ID NO: 1 (e.g., complete wild type Oplophorus luciferase sequence) and/or SEQ ID NO: 3 (e.g., complete NANOLUC sequence), wherein a pair of such peptides form a bioluminescent complex when combined under appropriate conditions (e.g., stabilized by an interaction pair, brought into proximity by co-localization elements, etc.) with a polypeptide having less than 100%, but more than 40% (e.g., >40%, >45%, >50%, >55%, >60%, >65%, >70%, >75%, >80%, >85%, >90%, >95%, >98%, >99%) sequence identity and/or similarity with another portion of SEQ ID NO: 1 (e.g., complete wild type Oplophorus luciferase sequence) and/or SEQ ID NO: 3 (e.g., complete NANOLUC sequence). Similarly, polypeptide components are provided that have less than 100%, but more than 40% (e.g., >40%, >45%, >50%, >55%, >60%, >65%, >70%, >75%, >80%, >85%, >90%, >95%, >98%, >99%) sequence identity or similarity with a portion of SEQ ID NO: 1 (e.g., complete wild type Oplophorus luciferase sequence) and/or SEQ ID NO: 3 (e.g., complete NANOLUC sequence), wherein such polypeptide components form a bioluminescent complex when combined under appropriate conditions with a pair of peptide tags having less than 100%, but optionally more than 40% (e.g., >40%, >45%, >50%, >55%, >60%, >65%, >70%, >75%, >80%, >85%, >90%, >95%, >98%, >99%) sequence identity and/or similarity with another portion SEQ ID NO: 1 (e.g., complete wild type Oplophorus luciferase sequence) and/or SEQ ID NO: 3 (e.g., complete NANOLUC sequence). In some embodiments, peptide tags with less than 100% sequence identity or similarity with SEQ ID NO: 6, SEQ ID NO: 7, SEQ ID NO: 9, and/or SEQ ID NO: 10 are provided. In some embodiments, peptide tags with less than 100%, but more than 40% (e.g., >40%, >45%, >50%, >55%, >60%, >65%, >70%, >75%, >80%, >85%, >90%, >95%, >98%, >99%) sequence identity or similarity with SEQ ID NO: 6, SEQ ID NO: 7, SEQ ID NO: 9, and/or SEQ ID NO: 10 are provided. In some embodiments, peptide tags with less than 100% sequence identity or similarity with SEQ ID NO: 23, SEQ ID NO: 25, and/or SEQ ID NO: 29 are provided. In some embodiments, peptide tags with less than 100%, but more than 40% (e.g., >40%, >45%, >50%, >55%, >60%, >65%, >70%, >75%, >80%, >85%, >90%, >95%, >98%, >99%) sequence identity or similarity with SEQ ID NO: 23, SEQ ID NO: 25, and/or SEQ ID NO: 29 are provided. In some embodiments, polypeptide components with less than 100% sequence identity or similarity with SEQ ID NO: 5 and/or SEQ ID NO: 8 are provided. In some embodiments, polypeptide components with less than 100% sequence identity or similarity with SEQ ID NO: 17 and/or SEQ ID NO: 27 are provided. In some embodiments, polypeptide components with less than 100%, but more than 40% (e.g., >40%, >45%, >50%, >55%, >60%, >65%, >70%, >75%, >80%, >85%, >90%, >95%, >98%, >99%) sequence identity or similarity with SEQ ID NO: 5, SEQ ID NO: 8, and/or SEQ ID NO: 27 are provided. In some embodiments, polypeptide components with less than 100%, but more than 40% (e.g., >40%, >45%, >50%, >55%, >60%, >65%, >70%, >75%, >80%, >85%, >90%, >95%, >98%, >99%) sequence identity or similarity with SEQ ID NO: 17 are provided.

In some embodiments, one or more (e.g., all) peptide/dipeptide/tripeptide tags (e.g., β6-like, β7-like, β8-like, β9-like (e.g., SmTrip9), and/or β10-like (e.g., SmTrip10) peptides, and/or dipeptides and tripeptides thereof) and a polypeptide components (e.g., β1-5-like, β1-6-like, β1-7-like, β1-8-like (e.g., LgTrip) polypeptide) in a set, kit, or system herein comprise 100% sequence identity with a portion of a luciferase (e.g., SEQ ID NO: 1, SEQ ID NO: 3, etc.).

In some embodiments, peptide tags (e.g., β9-like (e.g., SmTrip9) and β10-like (e.g., SmTrip10) peptides; β9/β10-like dipeptides; etc.) that find use in embodiments of the present invention include peptides with one or more amino acid substitutions, deletions, or additions from SEQ ID NO: 6, SEQ ID NO: 7, SEQ ID NO:9, SEQ ID NO: 10, SEQ ID NO: 23, SEQ ID NO: 25, SEQ ID NO: 29. In some embodiments, a peptide tag comprises at least 40% (e.g., >40%, >45%, >50%, >55%, >60%, >65%, >70%, >75%, >80%, >85%, >90%, >95%, >98%, >99%) sequence identity or similarity with SEQ ID NO: 13. In some embodiments, a peptide tag comprises 6 or fewer (e.g., 6, 5, 4, 3, 2, 1, or ranges there between) substitutions (e.g., conservative substitutions, semi-conservative substitutions, non-conservative substations, etc.) relative to SEQ ID NO: 13. In some embodiments, a peptide tag comprises at least 40% (e.g., >40%, >45%, >50%, >55%, >60%, >65%, >70%, >75%, >80%, >85%,>90%, >95%, >98%, >99%) sequence identity or similarity with SEQ ID NO: 25. In some embodiments, a peptide tag comprises 6 or fewer (e.g., 6, 5, 4, 3, 2, 1, or ranges there between) substitutions (e.g., conservative substitutions, semi-conservative substitutions, non-conservative substations, etc.) relative to SEQ ID NO: 25. In some embodiments, a peptide tag comprises at least 40% (e.g., >40%, >45%, >50%, >55%, >60%, >65%, >70%, >75%, >80%, >85%, >90%, >95%, >98%, >99%) sequence identity or similarity with SEQ ID NO: 23. In some embodiments, a peptide tag comprises 6 or fewer (e.g., 6, 5, 4, 3, 2, 1, or ranges there between) substitutions (e.g., conservative substitutions, semi-conservative substitutions, non-conservative substations, etc.) relative to SEQ ID NO: 23. In some embodiments, a peptide tag comprises at least 40% (e.g., >40%, >45%, >50%, >55%, >60%, >65%, >70%, >75%, >80%, >85%, >90%, >95%, >98%, >99%) sequence identity or similarity with SEQ ID NO: 25. In some embodiments, a peptide tag comprises 6 or fewer (e.g., 6, 5, 4, 3, 2, 1, or ranges there between) substitutions (e.g., conservative substitutions, semi-conservative substitutions, non-conservative substations, etc.) relative to SEQ ID NO: 25.

In some embodiments, peptide/dipeptide/tripeptide tags (e.g., β6-like, β7-like, β8-like, β9-like (e.g., SmTrip9), and/or β10-like (e.g., SmTrip10) peptides, and/or dipeptides and tripeptides thereof) and a polypeptide component (e.g., β1-5-like, β1-6-like, β1-7-like, β1-8-like (e.g., LgTrip) polypeptide) that find use in embodiments of the present invention include the peptides, dipeptides, tripeptides, and polypeptides disclosed herein and in the tables provided herein. In some embodiments, peptide/dipeptide/tripeptide tags (e.g., β6-like, β7-like, β8-like, β9-like (e.g., SmTrip9), and/or β10-like (e.g., SmTrip10) peptides, and/or dipeptides and tripeptides thereof) and a polypeptide component (e.g., β1-5-like, β1-6-like, (31-7-like, β1-8-like (e.g., LgTrip) polypeptide) that find use in embodiments of the present invention comprise one or more amino acid substitutions, deletions, or additions relative to the peptides, dipeptides, tripeptides, and polypeptides disclosed herein and in the tables provided herein. In some embodiments, a peptide/dipeptide/tripeptide tags (e.g., β6-like, 17-like, β8-like, β9-like (e.g., SmTrip9), and/or β10-like (e.g., SmTrip10) peptides, and/or dipeptides and tripeptides thereof) and a polypeptide component (e.g., β1-5-like, β1-6-like, β1-7-like, β1-8-like (e.g., LgTrip) polypeptide) that find use in embodiments of the present invention comprise at least 40% (e.g., >40%, >45%, >50%, >55%, >60%, >65%, >70%, >75%, >80%, >85%, >90%, >95%, >98%, >99%) sequence identity or similarity with the peptides, dipeptides, tripeptides, and polypeptides disclosed herein and in the tables provided herein.

In some embodiments, dipeptides and tripeptides that find use in embodiments herein comprise any suitable combinations of the peptides described herein and/or listed in the tables herein.

In some embodiments, a peptide/dipeptide/tripeptide tags (e.g., β6-like, β7-like, β8-like, β9-like (e.g., SmTrip9), and/or β10-like (e.g., SmTrip10) peptides, and/or dipeptides and tripeptides thereof) or a polypeptide component (e.g., β1-5-like, β1-6-like, β1-7-like, β1-8-like (e.g., LgTrip) polypeptide) is linked (e.g., chemically) or fused to one or more additional elements (e.g., recognition element, interaction element, co-localization element, detectable element (e.g., a fluorophore (e.g., to facilitate BRET)), protein of interest, HALOTAG, etc.).

In some embodiments, a peptide/dipeptide/tripeptide tag or polypeptide component is linked or fused to a cyOFP (e.g., in an Antares construct such as those described in U.S. Pat. No. 9,908,918; herein incorporated by reference in its entirety) or other fluorescent protein (e.g., to facilitate BRET). In some embodiments, a peptide/dipeptide/tripeptide tag or polypeptide component comprises one or more chemical modifications and/or unnatural amino acids or amino acid analogs to facilitate chemical conjugation of the polypeptide component with additional elements. In some embodiments, provided herein is a single peptide/dipeptide/tripeptide tag or polypeptide component fused to an acceptor fluorescent protein. In some embodiments, two or more peptide/dipeptide/tripeptide and/or polypeptide components are fused to an acceptor fluorescent protein (e.g., sandwhich fusion). In some embodiments, a peptide/dipeptide/tripeptide tag or polypeptide component is fused to two or more acceptor fluorescent protein (e.g., sandwhich fusion). In some embodiments, a LgTrip polypeptide (e.g., a $β_{1-8}$-like polypeptide described herein) is fused to a single fluorescent protein (e.g., cyOFP) or placed between two fluorescent proteins (e.g., two copies of a cyOFP) in a sandwich fusion.

In some embodiments, peptide/dipeptide/tripeptide tags (e.g., β6-like, β7-like, β8-like, β9-like (e.g., SmTrip9), and/or β10-like (e.g., SmTrip10) peptides, and/or dipeptides and tripeptides thereof) that find use in the present invention incorporate reactive groups suitable for chemical conjugation to an additional element (e.g., recognition element, interaction element, etc.). These reactive groups may be present on the N-terminus, C-terminus, or within the sequence. These reactive groups may optionally be attached to the peptide with a linker. In some cases, these peptide/dipeptide/tripeptide bearing reactive groups may be synthesized using standard synthesis and incorporated on an unnatural amino acid bearing the desired group. In some cases, the reactive group may be present on a natural amino acid (e.g. the sulfhydryl of cysteine). The additional element intended to react with a peptide tag bearing a reactive group may be a protein, an antibody, a nucleic acid, a small molecule such as a drug or a fluorophore or a surface. The peptide/dipeptide/tripeptide tag may incorporate a reactive group that is designed to react specifically with a reactive partner that has been chemically or biologically introduced on the additional element using bioorthogonal, or click, chemistry. An exemplary click reaction is copper catalyzed click where the peptide tag bears an alkyne or an azide, and the additional element bears the complementary group. Mixing these two species together in the presence of an appropriate copper catalyst causes the peptide to be covalently conjugated to the additional element through a triazole. Many other bioorthogonal reactions have been reported (for example Patterson, D. M., et al. (2014). "Finding the Right (Bioorthogonal) Chemistry." ACS Chemical Biology 9(3): 592-605.), and peptide tags and additional elements incorporating complementary reactive species are embodiments of the present invention.

Another embodiment of the present invention are peptide/dipeptide/tripeptide tags (e.g., β6-like, β7-like, β8-like, β9-like (e.g., SmTrip9), and/or β10-like (e.g., SmTrip10) peptides, and/or dipeptides and tripeptides thereof) and/or a polypeptide components (e.g., β1-5-like, β1-6-like, β1-7-like, β1-8-like (e.g., LgTrip) polypeptide) bearing reactive groups that react with naturally occurring amino acids. Exemplary reactive groups include maleimides for reaction with cysteine and succinimidyl esters for reaction with lysine. A more comprehensive list of reactive groups can be found in Koniev, O. and A. Wagner (2015). "Developments and recent advancements in the field of endogenous amino acid selective bond forming reactions for bioconjugation." Chem Soc Rev 44: 5495-5551. These reactive groups may be chemically or biologically introduced on a peptide/dipeptide/tripeptide/polypeptide through peptide synthesis or through other chemical modification of a peptide tag. In some embodiments, the peptide tag exists in a protected form (Isidro-Llobet, A., et al. (2009). "Amino Acid-Protecting Groups." Chemical Reviews 109(6): 2455-2504; herein incorporated by reference in its entirety), preventing the peptide/dipeptide/tripeptide/polypeptide itself from reacting with the reactive group. These reactive groups may react with a protein in a selective fashion or in a random fashion, yielding either one conjugate or a mixture of conjugates. In some embodiments, either a defined single conjugate or a mixture can be used successfully in this invention.

Examples of peptides (e.g., β9-like (e.g., SmTrip9) and β10-like (e.g., SmTrip10) peptides; β9/β10-like dipeptides; etc.) described herein bearing reactive groups suitable for chemical conjugation to an additional element (e.g., recognition element, interaction element, etc.) are displayed in FIGS. 95-98. Other combinations of reactive groups and peptides/dipeptides/tripeptides/polypeptides are within the scope herein.

In some embodiments, peptide/dipeptide/tripeptide tags (e.g., 36-like, $β_7$-like, 38-like, β9-like (e.g., SmTrip9), and/or β10-like (e.g., SmTrip10) peptides, and/or dipeptides and tripeptides thereof) and a polypeptide component (e.g., $β_{1-5}$-like, $β_{1-6}$-like, β1-7-like, β1-8-like (e.g., LgTrip) polypeptide) described herein is fused or conjugated to a detectable element such as a fluorophore or fluorescent protein. In such embodiments, complementation to form the bioluminescent complex, and the resultant bioluminescence, results in BRET and excitement of/emission from the attached detectable element (e.g., fluorophore or fluorescent protein). In such embodiments, the bioluminescent complex is a BRET energy donor, and the detectable element (e.g., fluorophore or fluorescent protein) attached to a component of the complex (e.g., peptide tag or polypeptide component) is the BRET energy acceptor.

Suitable fluorophores for use in a BRET system with the tripartite/multipartite complementation systems described herein include, but are not limited to: xanthene derivatives (e.g., fluorescein, rhodamine, Oregon green, eosin, Texas red, etc.), cyanine derivatives (e.g., cyanine, indocarbocyanine, oxacarbocyanine, thiacarbocyanine, merocyanine, etc.), naphthalene derivatives (e.g., dansyl and prodan derivatives), oxadiazole derivatives (e.g., pyridyloxazole, nitrobenzoxadiazole, benzoxadiazole, etc.), pyrene derivatives (e.g., cascade blue), oxazine derivatives (e.g., Nile red, Nile blue, cresyl violet, oxazine 170, etc.), acridine derivatives (e.g., proflavin, acridine orange, acridine yellow, etc.), arylmethine derivatives (e.g., auramine, crystal violet, malachite green, etc.), tetrapyrrole derivatives (e.g., porphin, phtalocyanine, bilirubin, etc.), CF dye (Biotium), BODIPY (Invitrogen), ALEXA FLUOR (Invitrogen), DYLIGHT FLUOR (Thermo Scientific, Pierce), ATTO and TRACY (Sigma Aldrich), FluoProbes (Interchim), DY and MEGA-STOKES (Dyomics), SULFO CY dyes (CYANDYE, LLC), SETAU AND SQUARE DYES (SETA BioMedicals), QUASAR and CAL FLUOR dyes (Biosearch Technologies), SURELIGHT DYES (APC, RPE, PerCP, Phycobilisomes) (Columbia Biosciences), APC, APCXL, RPE, BPE (Phyco-Biotech), autofluorescent proteins (e.g., YFP, RFP, mCherry, mKate), quantum dot nanocrystals, etc. In some embodiments, a fluorophore is a rhodamine analog (e.g., carboxy rhodamine analog), such as those described in U.S. patent application Ser. No. 13/682,589, herein incorporated by reference in its entirety.

In other embodiments, peptide/dipeptide/tripeptide tags (e.g., β6-like, β7-like, β8-like, β9-like (e.g., SmTrip9), and/or β10-like (e.g., SmTrip10) peptides, and/or dipeptides and tripeptides thereof) and a polypeptide component (e.g., β1-5-like, β1-6-like, β1-7-like, β1-8-like (e.g., LgTrip) polypeptide) described herein is fused or conjugated to a detectable element such as a fluorophore or fluorescent protein (e.g., green fluorescent protein (GFP), enhanced GFP (EGFP), cyan fluorescent protein (CFP), yellow fluorescent protein (YFP), and variants thereof. In other embodiments, a peptide tag or polypeptide component described herein is fused or conjugated to a cyan-excitable orange-red fluorescent protein (CyOFP), such as those described in U.S. Pat. No. 9,908,918; herein incorporated by reference in its entirety. In some embodiments, the CyOFP and BRET systems described in U.S. Pat. No. 9,908,918 find use with the peptide tags and/or polypeptide components described herein (e.g., CyOFP-(($β_9$-like peptide), CyOFP-($β_{10}$-like peptide), CyOFP-($β_{1-8}$-like polypeptide), CyOFP-($β_{9-10}$-like peptide), CyOFP-(($β_9$-like peptide)-CyOFP, CyOFP-($β_{10}$-like peptide)-CyOFP, CyOFP-($β_{1-8}$-like polypeptide)-CyOFP, CyOFP-(($β_{9-10}$-like peptide)—CyOFP, etc.). In some embodiments, such systems comprising CyOFP linked to peptide/dipeptide/tripeptide tags and/or polypeptide components herein may be referred to herein as "Antares constructs" or "Antares systems." Such BRET systems are particularly useful in certain imaging applications (Schaub, F. X., et al. (2015) "Fluorophore-NanoLuc® BRET Reporters Enable Sensitive In Vivo Optical Imaging and Flow Cytometry for Monitoring Tumorigenesis." Cancer Research 75(23): 5023-5033; herein incorporated by reference in its entirety).

In other embodiments, peptide/dipeptide/tripeptide tags (e.g., β6-like, β7-like, β8-like, β9-like (e.g., SmTrip9), and/or β10-like (e.g., SmTrip10) peptides, and/or dipeptides and tripeptides thereof) and a polypeptide component (e.g., β1-5-like, β1-6-like, β1-7-like, β1-8-like (e.g., LgTrip) polypeptide) described herein are linked to fluorophores (e.g., directly or via a linker) for use in a constitutive BRET system (e.g., an Antares-like system). In constitutive BRET systems, the emission spectrum is shifted from the bioluminescence spectrum toward that of the fluorophore (e.g., for better sensitivity, lower scattering, desired emission wavelength, etc.). In other embodiments, peptide/dipeptide/tripeptide tags and/or polypeptide components described herein find use as functional sensors (e.g., for monitoring cellular/intracellular/intercellular processes (e.g., for detecting calcium flux or voltage (Suzuki, K., et al. (2016). "Five colour variants of bright luminescent protein for real-time multicolour bioimaging." Nature Communications 7: 13718.; Inagaki, S., et al. (2017). "Genetically encoded bioluminescent voltage indicator for multi-purpose use in wide range of bioimaging." Sci Rep 7: 42398; herein incorporated by reference in their entireties)), for imaging, for optogenetics, etc.).

In some embodiments, two or more of the peptide/dipeptide/tripeptide tags (e.g., β6-like, β7-like, β8-like, β9-like (e.g., SmTrip9), and/or β10-like (e.g., SmTrip10) peptides, and/or dipeptides and tripeptides thereof) and a polypeptide component (e.g., β1-5-like, β1-6-like, β1-7-like, β1-8-like (e.g., LgTrip) polypeptide) are attached to a single interaction element that can access multiple conformations. In one conformation, the peptide/dipeptide/tripeptide tags and the polypeptide are unable to form a luminescent complex. Upon changing conformation, i.e., in response to a stimulus, the peptide/dipeptide/tripeptide tags are brought into a conformation where they can form a bioluminescent complex. As an example, a SmTrip9 peptide and a SmTrip10 peptide can be conjugated to calmodulin such that they do not form a luminescent complex even in the presence of LgTrip and furimazine. Upon exposure to calcium, the conformational change of calmodulin bring the SmTrip9 peptide and SmTrip10 peptide into a position whereupon addition of LgTrip makes a complex that is bioluminescent in the presence of furimazine. Many other biosensors for calcium and other stimuli (pH, voltage, etc.) are known in the literature.

In some embodiments, systems herein find use in multiplexable analyte detection. In some embodiments, peptide/dipeptide/tripeptide tags (e.g., β6-like, β7-like, β8-like, β9-like (e.g., SmTrip9), and/or β10-like (e.g., SmTrip10) peptides, and/or dipeptides and tripeptides thereof) that find use in the present invention are conjugated to both an interaction element and a reporter element. In some embodiments, the interaction element is an antibody or the like, and the reporter element is a small molecule fluorophore. In some embodiments, antibodies to different pathogens (e.g. Zika virus, Dengue virus, etc.) are conjugated to a peptide/dipeptide/tripeptide tag (e.g., a SmTrip9 peptide) and a fluorophore with a different and distinguishable wavelength. In this embodiment, the luminescent complex that is formed upon the antibody binding to its antigen emits light at the emission wavelength of the bound fluorophore due to bioluminescence resonance energy transfer. This allows the antibodies to all be present in the same well, device, etc., and the identity of the antigen detected to be determined by the color of the light emitted by the luminescent complex formed.

In some embodiments, polypeptide components (e.g., β1-8-like (e.g., LgTrip) polypeptide) that find use in embodiments of the present invention include polypeptides with one or more amino acid substitutions, deletions, or additions from SEQ ID NO: 5 and/or SEQ ID NO: 8. In some embodiments, a polypeptide component comprises at least 40% (e.g., >40%, >45%, >50%, >55%, >60%, >65%, >70%, >75%, >80%, >85%, >90%, >95%, >98%, >99%) sequence identity or similarity with SEQ ID NO: 11. In some embodiments, polypeptide component comprises 100 or fewer (e.g., 100, 90, 80, 70, 60, 50, 40, 30, 25, 20, 15, 10, 9, 8, 7, 6, 5, 4, 3, 2, 1, or ranges there between) substitutions (e.g., conservative substitutions, semi-conservative substitutions, non-conservative substations, etc.) relative to SEQ ID NO: 11. In some embodiments, a polypeptide component comprises at least 40% (e.g., >40%, >45%, >50%, >55%, >60%, >65%, >70%, >75%, >80%, >85%, >90%, >95%, >98%, >99%) sequence identity or similarity with SEQ ID NO: 17. In some embodiments, a polypeptide component comprises 100 or fewer (e.g., 100, 90, 80, 70, 60, 50, 40, 30, 25, 20, 15, 10, 9, 8, 7, 6, 5, 4, 3, 2, 1, or ranges there between) substitutions (e.g., conservative substitutions, semi-conservative substitutions, non-conservative substations, etc.) relative to SEQ ID NO: 17. In some embodiments, a polypeptide component comprises at least 40% (e.g., >40%, >45%, >50%, >55%, >60%, >65%, >70%, >75%, >80%, >85%, >90%, >95%, >98%, >99%) sequence identity or similarity with SEQ ID NO: 17, SEQ ID NO: 21, and/or SEQ ID NO: 302. In some embodiments, a polypeptide component comprises 100 or fewer (e.g., 100, 90, 80, 70, 60, 50, 40, 30, 25, 20, 15, 10, 9, 8, 7, 6, 5, 4, 3, 2, 1, or ranges there between) substitutions (e.g., conservative substitutions, semi-conservative substitutions, non-conservative substations, etc.) relative to SEQ ID NO: 17, SEQ ID NO: 21, and/or SEQ ID NO: 302. In some embodiments, a polypeptide component comprises at least 40% (e.g., >40%, >45%, >50%, >55%, >60%, >65%, >70%, >75%, >80%, >85%, >90%, >95%, >98%, >99%) sequence identity or similarity with SEQ ID NO: 788. In some embodiments, polypeptide component comprises 100 or fewer (e.g., 100, 90, 80, 70, 60, 50, 40, 30, 25, 20, 15, 10, 9, 8, 7, 6, 5, 4, 3, 2, 1, or ranges there between) substitutions (e.g., conservative substitutions, semi-conservative substitutions, non-conservative substations, etc.) relative to SEQ ID NO: 788. In some embodiments, a polypeptide component comprises at least 40% (e.g., >40%, >45%, >50%, >55%, >60%, >65%, >70%, >75%, >80%, >85%, >90%, >95%, >98%, >99%) sequence identity or similarity with SEQ ID NO: 789. In some embodiments, polypeptide component comprises 100 or fewer (e.g., 100, 90, 80, 70, 60, 50, 40, 30, 25, 20, 15, 10, 9, 8, 7, 6, 5, 4, 3, 2, 1, or ranges there between) substitutions (e.g., conservative substitutions, semi-conservative substitutions, non-conservative substations, etc.) relative to SEQ ID NO: 789.

In some embodiments, a polypeptide component (e.g., β1-5-like, β1-6-like, β1-7-like, β1-8-like (e.g., LgTrip) polypeptide) is linked (e.g., chemically) or fused to one or more additional elements (e.g., recognition element, interaction element, co-localization element, detectable element (e.g., a fluorophore (e.g., to facilitate BRET)), protein of interest, HALOTAG, etc.). In some embodiments, a polypeptide component is linked or fused to a cyOFP (e.g., in an Antares construct such as those described in U.S. Pat. No. 9,908,918; herein incorporated by reference in its entirety) or other fluorescent protein (e.g., to facilitate BRET). In some embodiments, a polypeptide component comprises one or more chemical modifications and/or unnatural amino acids or amino acid analogs to facilitate chemical conjugation of the polypeptide component with additional elements.

In some embodiments, a peptide tag (e.g., β9-like (e.g., SmTrip9) and β10-like (e.g., SmTrip10) peptides; β9/β10-like dipeptides; etc.) and/or peptide component is not identical to and/or is not exact subsequences of one or more (e.g., all) of SEQ ID NO: 1, SEQ ID NO: 3, SEQ ID NO: 5, SEQ ID NO: 7, SEQ ID NO: 9, SEQ ID NO: 11, SEQ ID NO: 13, SEQ ID NO: 17, SEQ ID NO: 21, SEQ ID NO: 23, SEQ ID NO: 25, SEQ ID NO: 27, SEQ ID NO: 29, SEQ ID NO: 51, SEQ ID NO: 302 (or any combinations thereof). In other embodiments, a peptide tag and/or peptide component is identical to and/or is an exact subsequences one or more (e.g., all) of SEQ ID NO: 1, SEQ ID NO: 3, SEQ ID NO: 5, SEQ ID NO: 7, SEQ ID NO: 9, SEQ ID NO: 11, SEQ ID NO: 13, SEQ ID NO: 17, SEQ ID NO: 21, SEQ ID NO: 23, SEQ ID NO: 25, SEQ ID NO: 27, and/or SEQ ID NO: 29, SEQ ID NO: 51, SEQ ID NO: 302 (or any combinations thereof).

In some embodiments, a polypeptide component (e.g., β1-8-like (e.g., LgTrip) polypeptide) corresponds to and comprises substantial sequence identity (e.g., >40%, >45%, >50%, >55%, >60%, >65%, >70%, >75%, >80%, >85%, >90%, >95%, >99%, 100%) with a portion of SEQ ID NO: 3. For example, in some embodiments, a polypeptide component corresponds to, and comprises substantial sequence identity (e.g., >40%, >45%, >50%, >55%, >60%, >65%, >70%, >75%, >80%, >85%, >90%, >95%, >99%, 100%) with positions 1, 2, 3, 4, 5, 6, 7, 8, 9, 10, 11, or 12 through 142, 143, 144, 145, 146, 147, 148, 149, 150, 152, 153 of SEQ ID NO: 3 (e.g., positions 1-148).

In some embodiments, a peptide tag (β10-like (e.g, SmTrip10) peptide) corresponds to and comprises substantial sequence identity (e.g., >40%, >50%, >60%, >70%, >80%, >90%, 100%) with a portion of SEQ ID NO: 3. For example, in some embodiments, a peptide tag corresponds to, and comprises substantial sequence identity (e.g., >40%, >45%, >50%, >55%, >60%, >65%, >70%, >75%, >80%, >85%, >90%, >95%, >99%, 100%) with positions 154, 155, 156, 157, 158, 159, 160, 161, 162, 163, 163, or 164 through 166, 167, 168, 169, 170, or 171 of SEQ ID NO: 3 (e.g., positions 160-171).

In some embodiments, a peptide tag (β9-like (e.g., SmTrip9) peptide) corresponds to and comprises substantial sequence identity (e.g., >40%, >50%, >60%, >70%, >80%, >90%, 100%) with a portion of SEQ ID NO: 3. For example, in some embodiments, a peptide tag corresponds to, and comprises substantial sequence identity (e.g., >40%, >45%, >50%, >55%, >60%, >65%, >70%, >75%, >80%, >85%, >90%, >95%, >99%, 100%) with positions 142, 143, 144, 145, 146, 147, 148, 149, 150, 152, 153 through 154, 155, 156, 157, 158, 159, 160, 161, 162, 163, 163, or 164 of SEQ ID NO: 3.

In some embodiments, a polypeptide component e.g., β1-8-like (e.g., LgTrip) polypeptide), a first peptide tag (β9-like (e.g., SmTrip9) peptide) and a second peptide tag (β10-like (e.g., SmTrip10) peptide) together correspond to and comprise substantial sequence identity (e.g., >40%, >50%, >60%, >70%, >80%, >90%, 100%) with at least 90% of the length of SEQ ID NO: 3.

In some embodiments, peptide/dipeptide/tripeptide tags (e.g., β6-like, β7-like, β8-like, β9-like (e.g., SmTrip9), and/or β10-like (e.g., SmTrip10) peptides, and/or dipeptides and tripeptides thereof) and a polypeptide component (e.g., β1-5-like, β1-6-like, β1-7-like, β1-8-like (e.g., LgTrip) polypeptide) comprise one or more substitutions relative to SEQ ID NO: 1 and/or SEQ ID NO: 3. For example, in some embodiments, a polypeptide component comprises 40% or greater (e.g., 40%, 45%, 50%, 55%, 60%, 65%, 70%, 75%, 80%, 85%, 90%, 95%, 99%) sequence identity with SEQ ID NO: 3 or a portion thereof (e.g., SEQ ID NO: 11, SEQ ID NO: 17, etc.), but comprise a substitution at one or more of positions 4, 30, 42, and/or 106 relative to SEQ ID NO: 17. In some embodiments, a polypeptide component comprises an E4D substitution relative to SEQ ID NO: 17. In some embodiments, a polypeptide component comprises an A, D, E, G, K, L, M, N, Q, S, T, V, or Y at position 30 relative to SEQ ID NO: 17. In some embodiments, a polypeptide component comprises an A, C, F, G, I, L, M, S, T, or V at position 42 relative to SEQ ID NO: 17. In some embodiments, a polypeptide component comprises a D, K, or Q at position 106 relative to SEQ ID NO: 17.

In some embodiments, a polypeptide component (e.g., β1-5-like, β1-6-like, β1-7-like, β1-8-like (e.g., LgTrip) polypeptide) is an artificial sequence that comprises 70% or greater (e.g., 75%, 80%, 85%, 90%, 95%, 100%, or ranges there between) sequence identity and/or sequence similarity with one or more of SEQ ID NOS: 19, 21, 39, 41, 43, 45, 47, 49, 51, 53, 55, 57, 59, 61, 63, 65, 67, 69, 71, 73, 75, 77, 79, 81, 83, 85, 87, 89, 91, 93, 95, 97, 99, 101, 103, 105, 107, 109, 111, 113, 115, 117, 119, 121, 123, 125, 127, 129, and 131 (or the r 1-5-like, $β_{1-6}$-like, or 1-7-like portion thereof). In some embodiments, a polypeptide component is an artificial sequence that comprises all or a portion (e.g., 50 amino acids, 60 amino acids, 70 amino acids, 80 amino acids, 90 amino acids, 100 amino acids, 110 amino acids, 120 amino acids, 130 amino acids, 140, or more, or ranges there between) of one of SEQ ID NOs: 19, 21, 39, 41, 43, 45, 47, 49, 51, 53, 55, 57, 59, 61, 63, 65, 67, 69, 71, 73, 75, 77, 79, 81, 83, 85, 87, 89, 91, 93, 95, 97, 99, 101, 103, 105, 107, 109, 111, 113, 115, 117, 119, 121, 123, 125, 127, 129, and 131 (or the r β1-5-like, $β_{1-6}$-like, or β1-7-like portion thereof). In some embodiments, a polypeptide component is a sequence consisting of one of SEQ ID NOs: 19, 21, 39, 41, 43, 45, 47, 49, 51, 53, 55, 57, 59, 61, 63, 65, 67, 69, 71, 73, 75, 77, 79, 81, 83, 85, 87, 89, 91, 93, 95, 97, 99, 101, 103, 105, 107, 109, 111, 113, 115, 117, 119, 121, 123, 125, 127, 129, and 131 (or the r β1-5-like, $β_{1-6}$-like, or β1-7-like portion thereof).

In some embodiments, a peptide/dipeptide/tripeptide tag ((e.g., β6-like, β7-like, β8-like, β9-like (e.g., SmTrip9), and/or β10-like (e.g., SmTrip10) peptides, and/or dipeptides and tripeptides thereof) is an artificial sequence that comprises 70% or greater (e.g., 75%, 80%, 85%, 90%, 95%, 100%, or ranges there between) sequence identity and/or sequence similarity with one or more of the peptide sequences listed in Table 1, Table 9, Table 10, or dipeptide/tripeptide combinations thereof. In some embodiments, a peptide/dipeptide/tripeptide tag component is an artificial sequence that comprises all or a portion (e.g., 5 amino acids, 6 amino acids, 7 amino acids, 8 amino acids, 9 amino acids, 10 amino acids, 11 amino acids, 12 amino acids, 13 amino acids, 14, or more, or ranges there between) of one of the peptide sequences listed in Table 1, Table 9, Table 10, or dipeptide/tripeptide combinations thereof. In some embodiments, a peptide/dipeptide/tripeptide tag component is a sequence consisting of one of the peptide sequences listed in Table 1, Table 9, Table 10, or dipeptide/tripeptide combinations thereof.

Although referred to herein as peptide/dipeptide/tripeptide e.g., β6-like, β7-like, β8-like, β9-like (e.g., SmTrip9), and/or β10-like (e.g., SmTrip10) peptides, and/or dipeptides and tripeptides thereof), in some embodiments, one or more of the peptide/dipeptide/tripeptide components of a bioluminescent complex within the scope herein are not attached to an interaction element, co-localization element, binding agent, protein of interest, molecule of interest, or any other moiety. In some embodiments, one or both of the peptide/dipeptide/tripeptide components interact with the polypeptide and other peptide/dipeptide/tripeptide components to form a luminescent complex without being fused or otherwise tethered to another element.

In some embodiments, a peptide/dipeptide/tripeptide tags (e.g., β6-like, β7-like, β8-like, β9-like (e.g., SmTrip9), and/or β10-like (e.g., SmTrip10) peptides, and/or dipeptides and tripeptides thereof) and a polypeptide component (e.g., β1-5-like, β1-6-like, β1-7-like, β1-8-like (e.g., LgTrip) polypeptide) of a luminescent complex, a co-localization element, and/or an interaction element comprises a synthetic peptide/polypeptide, a peptide/polypeptide containing one or more non-natural amino acids, a peptide/polypeptide containing one or more amino acid analogs, a peptide/polypeptide mimetic, a conjugated synthetic peptide (e.g., conjugated to a functional group (e.g., fluorophore, luminescent substrate, etc.)), etc.

Provided herein are compositions and methods that are useful in a variety of fields including basic research, medical research, molecular diagnostics, etc. Although the reagents and assays described herein are not limited to any particular applications, and any useful application should be viewed as being within the scope of the present invention, the following are exemplary assays, kits, fields, experimental set-ups, etc. that make use of the presently claimed invention.

Typical applications that make use of embodiments herein involve the monitoring/detection of protein dimerization (e.g., heterodimers, homodimers), protein-protein interactions, protein-RNA interactions, protein-DNA interactions, antibody (or other recognition element) binding to a target, nucleic acid hybridization, protein-small molecule interactions, analyte quantitation or detection, or any other combinations of molecular entities. In an exemplary embodiment, a first entity of interest is attached to a first peptide/dipeptide/tripeptide tags (e.g., β6-like, β7-like, β8-like, β9-like (e.g., SmTrip9), and/or β10-like (e.g., SmTrip10) peptides, and/or dipeptides and tripeptides thereof) and a second entity of interest is attached to the second peptide/dipeptide/tripeptide tags (e.g., β6-like, β7-like, β8-like, β9-like (e.g., SmTrip9), and/or β10-like (e.g., SmTrip10) peptides, and/or dipeptides and tripeptides thereof). If a detectable signal is produced under the particular assay conditions (e.g., in the presence of a polypeptide component of the luminescent complex (e.g., β1-5-like, β1-6-like, β1-7-like, β1-8-like (e.g., LgTrip) polypeptide) and a coelenterazine or a coelenterazine analog substrate), then interaction and/or co-localization of the first and second entities is inferred. Such assays are useful for monitoring molecular interactions and/or localization under any suitable conditions (e.g., in vitro, in vivo, in situ, whole animal, etc.), and find use in, for example, drug discovery, elucidating molecular pathways, studying equilibrium or kinetic aspects of complex assembly, high throughput screening, proximity sensor, etc.

In some embodiments, the systems and methods provided herein are useful for the detection, quantification, analysis, characterization, etc. of: an analyte, analytes, co-localization of analytes, and/or molecular interaction of analytes. In some embodiments, a peptide/dipeptide/tripeptide tags (e.g., β6-like, β7-like, β8-like, β9-like (e.g., SmTrip9), and/or β10-like (e.g., SmTrip10) peptides, and/or dipeptides and tripeptides thereof) is tethered/fused to an analyte. In some embodiments, a peptide/dipeptide/tripeptide tag is tethered/fused to a recognition element agent that binds to a target analyte.

Suitable analytes that find use (e.g., are analyzed) in embodiments herein include, but are not limited to: nucleic acids (e.g., DNA, RNA, miRNA, etc.), proteins (ex: bacterial antigens, viral antigens, biomarkers, antibodies, etc.), small molecules, toxins, biomarkers, environmental or food contaminants, surfactants, pathogens (e.g., viral antigens and proteins, bacterial antigens and proteins, etc.), drugs (e.g., therapeutic drugs, drugs of abuse, etc.), vitamins, cytokines, antibodies (e.g., autoantibodies, infectious disease exposure, therapeutic drug monitoring, anti-HLA transplantation rejection, etc.), cells, cell receptor proteins, biomarker based diagnostics, cell free nucleic acids and non-cell free nucleic acids (e.g., DNA, RNA, mRNA, miRNA, etc.), nucleic acid SNPs, extracted nucleic acids, non-amplified nucleic acid samples, genomic DNA, ssDNA, bacterial resistance genes, immunocomplexes (e.g., antigen:antibody complex; antigen:complement complex, etc.), blood sugars, hormones, metabolites, microbes, parasites, enzymes, transcription factors, metal ions/heavy metals, etc.

Suitable recognition elements or binding moieties that find use (e.g., fused/tethered to a peptide tag, binding to an analyte, etc.) in embodiments herein, include, but are not limited to: antibodies (e.g., monoclonal, polyclonal, recombinant, animal derived, autoantibody, biotherapeutic, etc.), antibody variable heavy chain, antibody variable light chain, antibody binding fragment (Fab) [F(ab)'2], camelid, single chain variable fragment (scFv), monomeric proteins, receptor domains, affibodies, monobodies, natural and derivatized nucleic acid aptamers (e.g., RNA aptamer, DNA aptamer, chemical modified aptamer, etc.), peptide nucleic acids (PNA), locked nucleic acids (LNA), hexitol nucleic acids (HNA), protein A, G, L, M and/or domains thereof, sequence specific oligonucleotide probes (e.g., DNA probe, RNA probe, etc.), small molecule drug, antibody-oligonucleotide conjugates, darpins, nanobodies, affimers, adhirons, anticalins, phage, magnetic particles (e.g., labeled directly or labeled with a tagged recognition element), nanoparticles (e.g., polystyrene nanospheres, etc.) labeled directed or labeled with a tagged recognition element, streptavidin, antigens, etc.

Figure 99A:
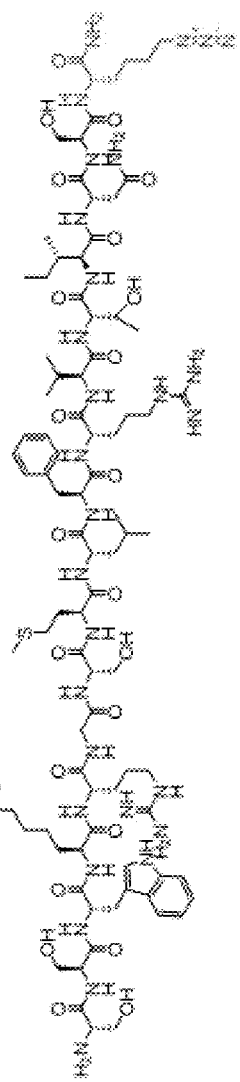
FIG. 99A-B. Exemplary peptide-oligomer probes. Peptides displaying reactive azido groups are conjugated to oligonucleotides displaying reactive alkyne groups to form exemplary peptide-oligomer probes.(A) Peptide oligomer conjugate of SmTrip9 pep286 (w/azido group) conjugated to a DNA oligomer containing 5'-terminal alkyne functionality via a copper "click" 1,3-cycloaddition. (B) Peptide oligomer conjugate of SmTrip10 pep86 (HiBiT) (w/azido group) conjugated to a DNA oligomer containing 3'-terminal alkyne functionality via a copper "click" 1,3-cycloaddition.
Figure 99B:
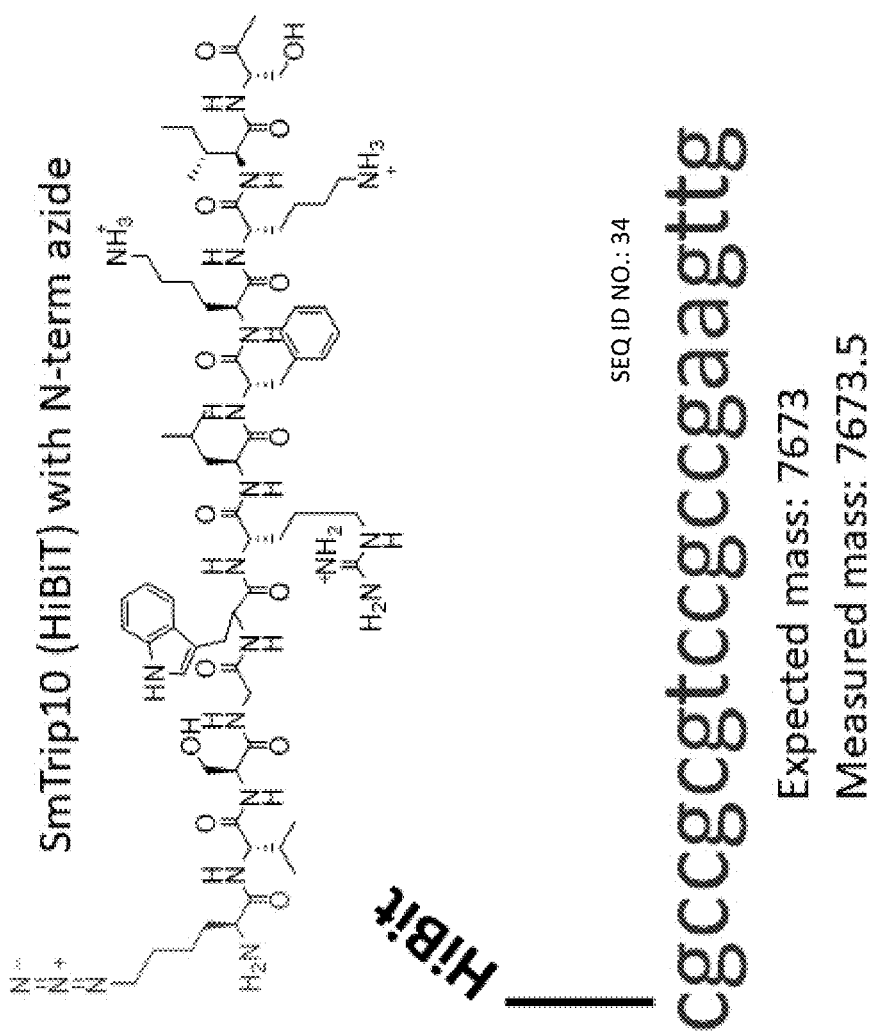
Figure 100:
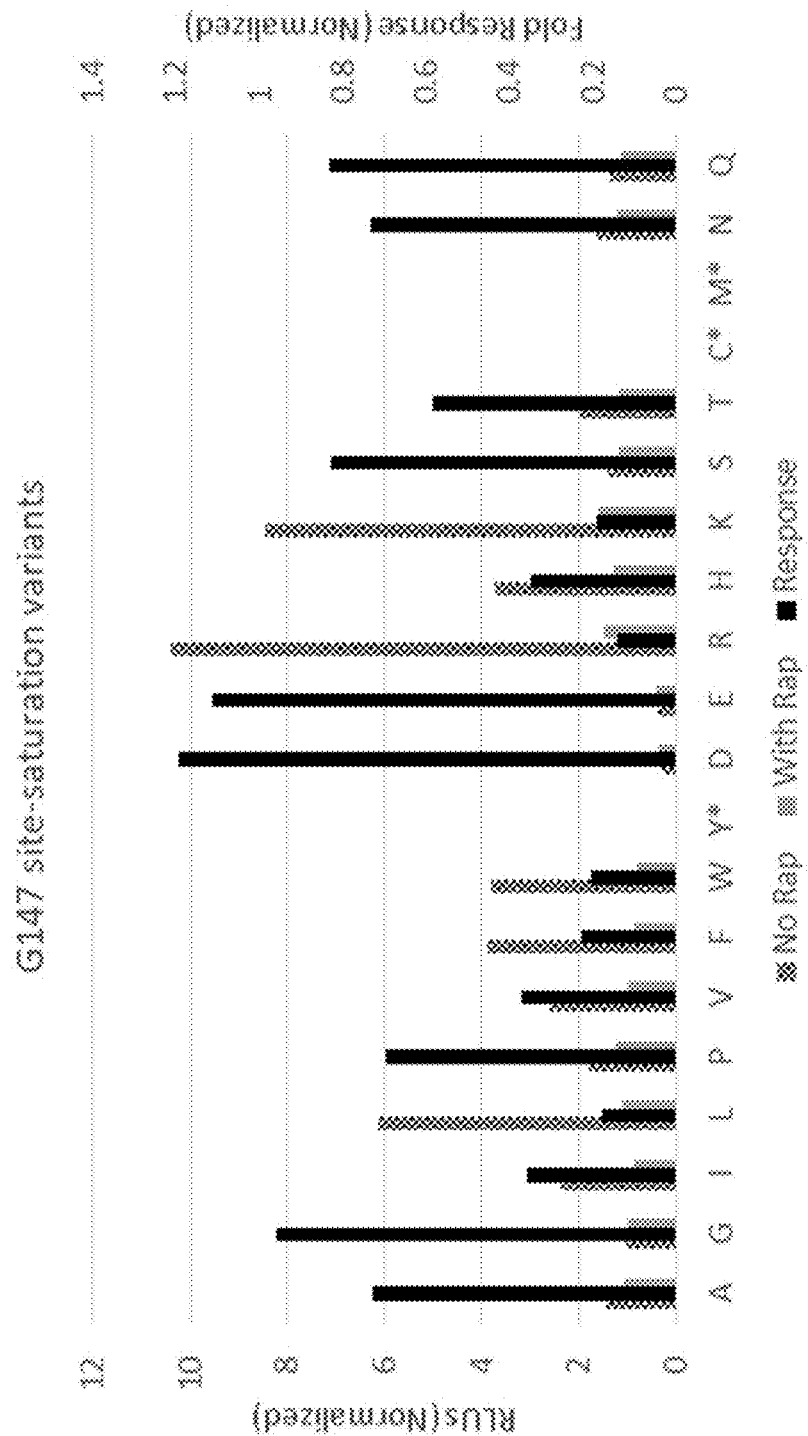
FIG. 100. Graph depicting a screen of SmTrip9 G147 site-saturation variants.
Figure 101:
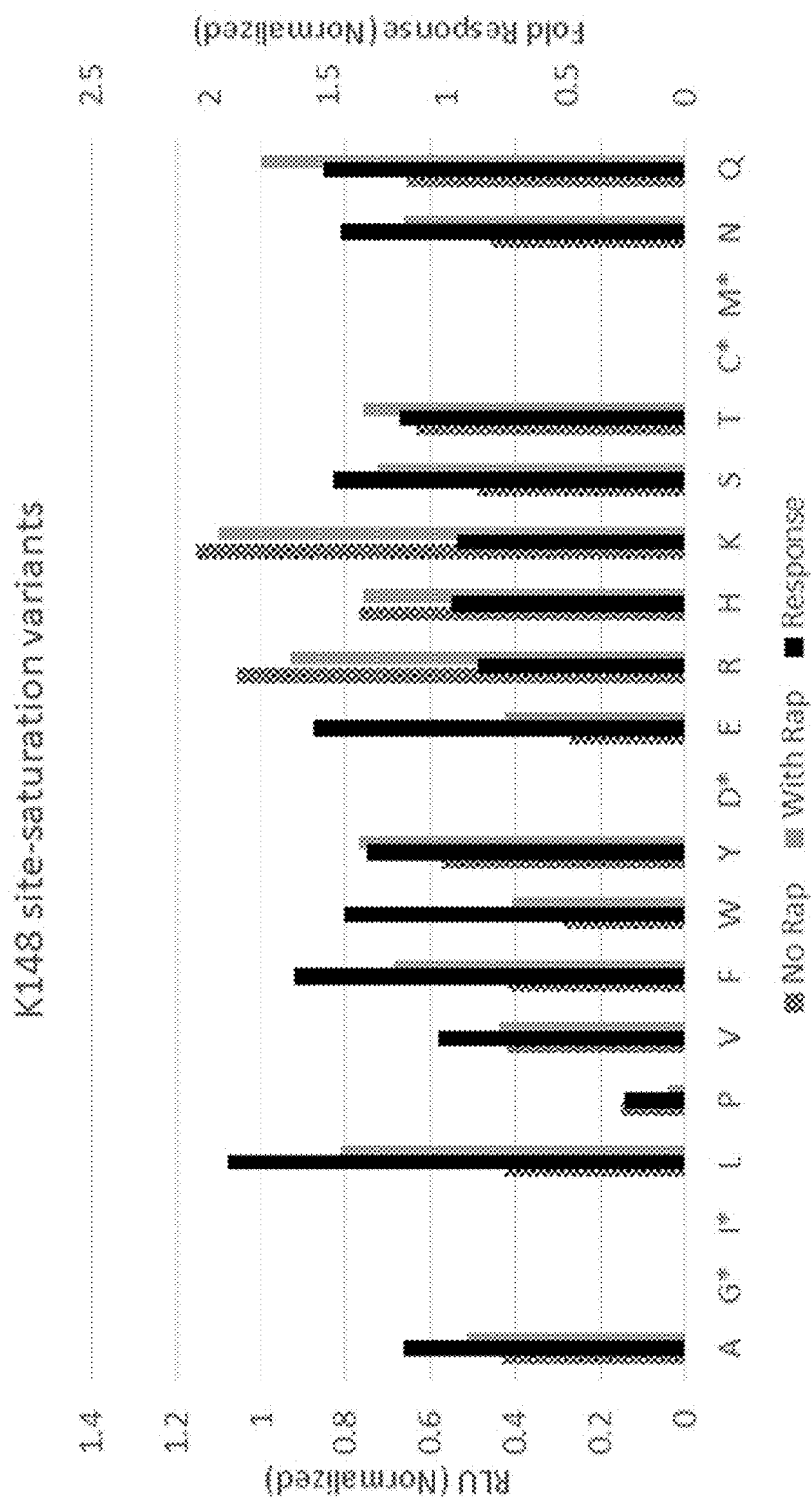
FIG. 101. Graph depicting a screen of SmTrip9 K148 site-saturation variants.
Figure 102:
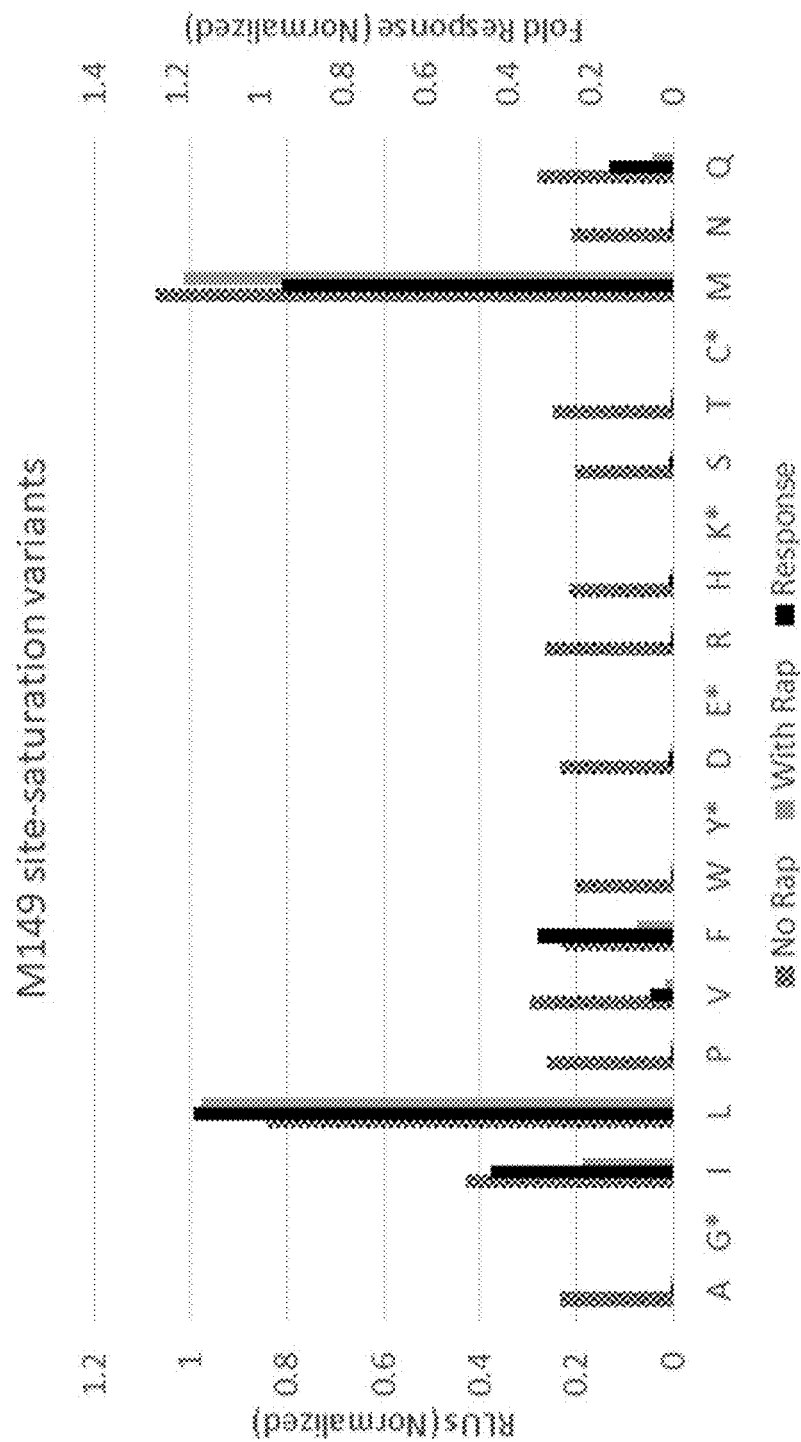
FIG. 102. Graph depicting a screen of SmTrip9 M149 site-saturation variants.
Figure 103:
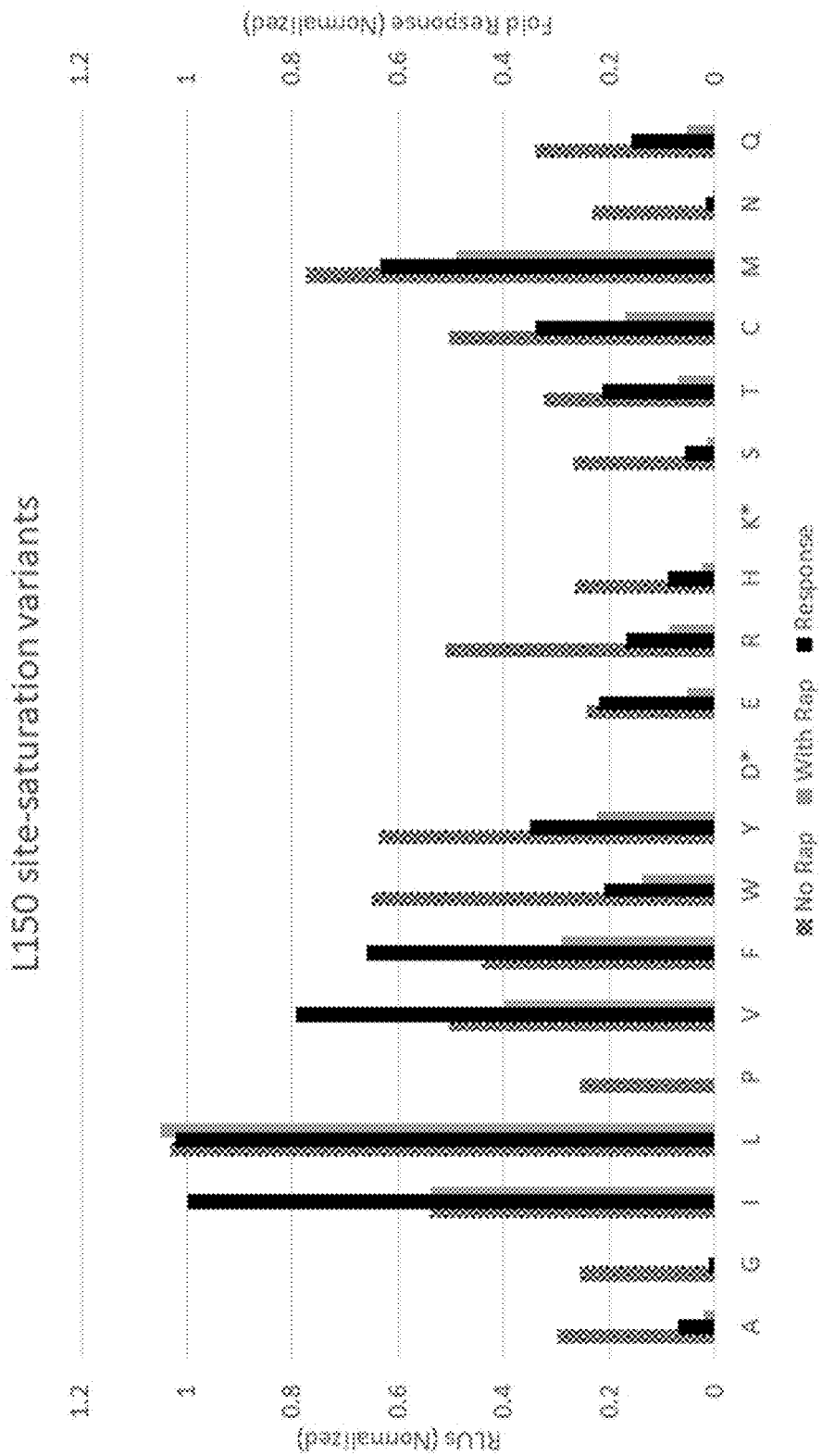
FIG. 103. Graph depicting a screen of SmTrip9 L150 site-saturation variants.
Figure 104:
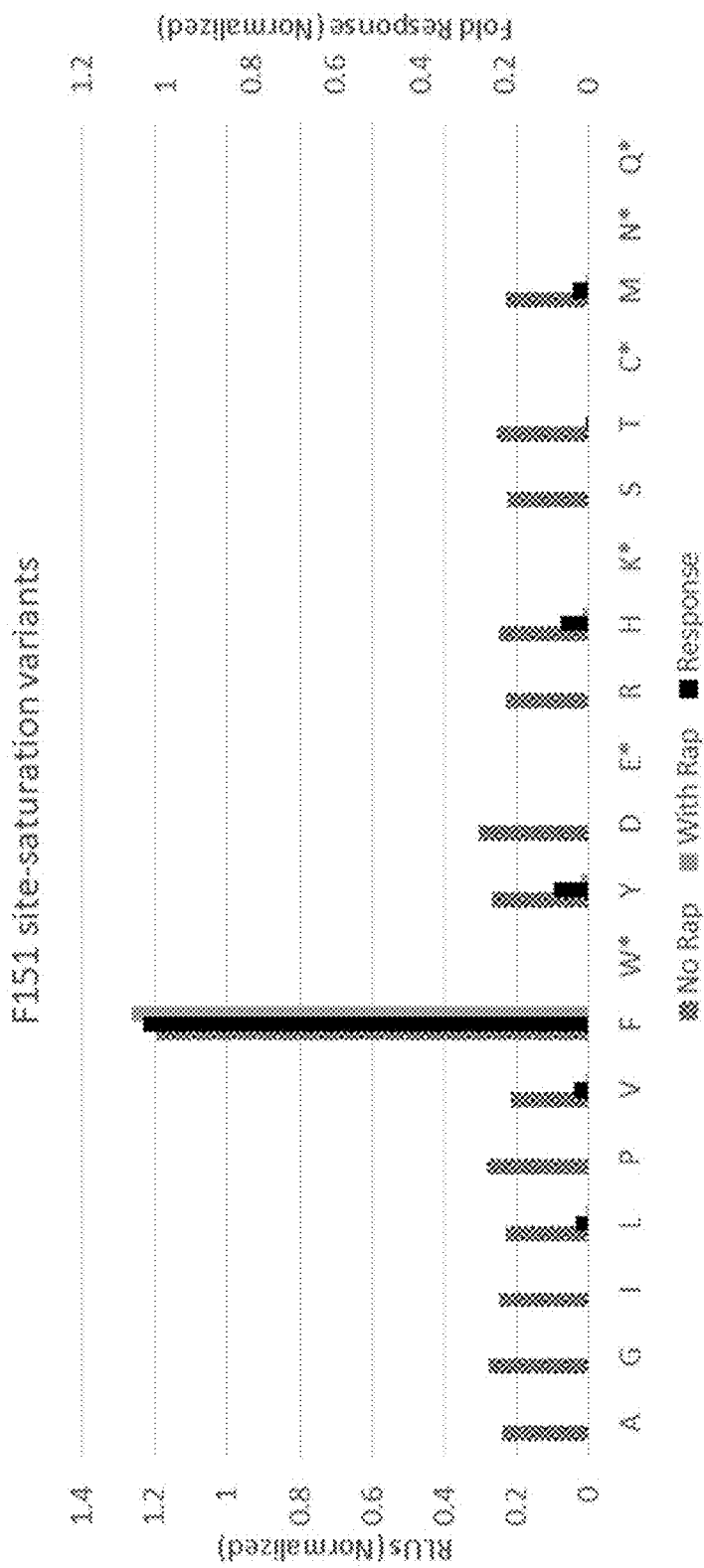
FIG. 104. Graph depicting a screen of SmTrip9 F151 site-saturation variants.
Figure 105:
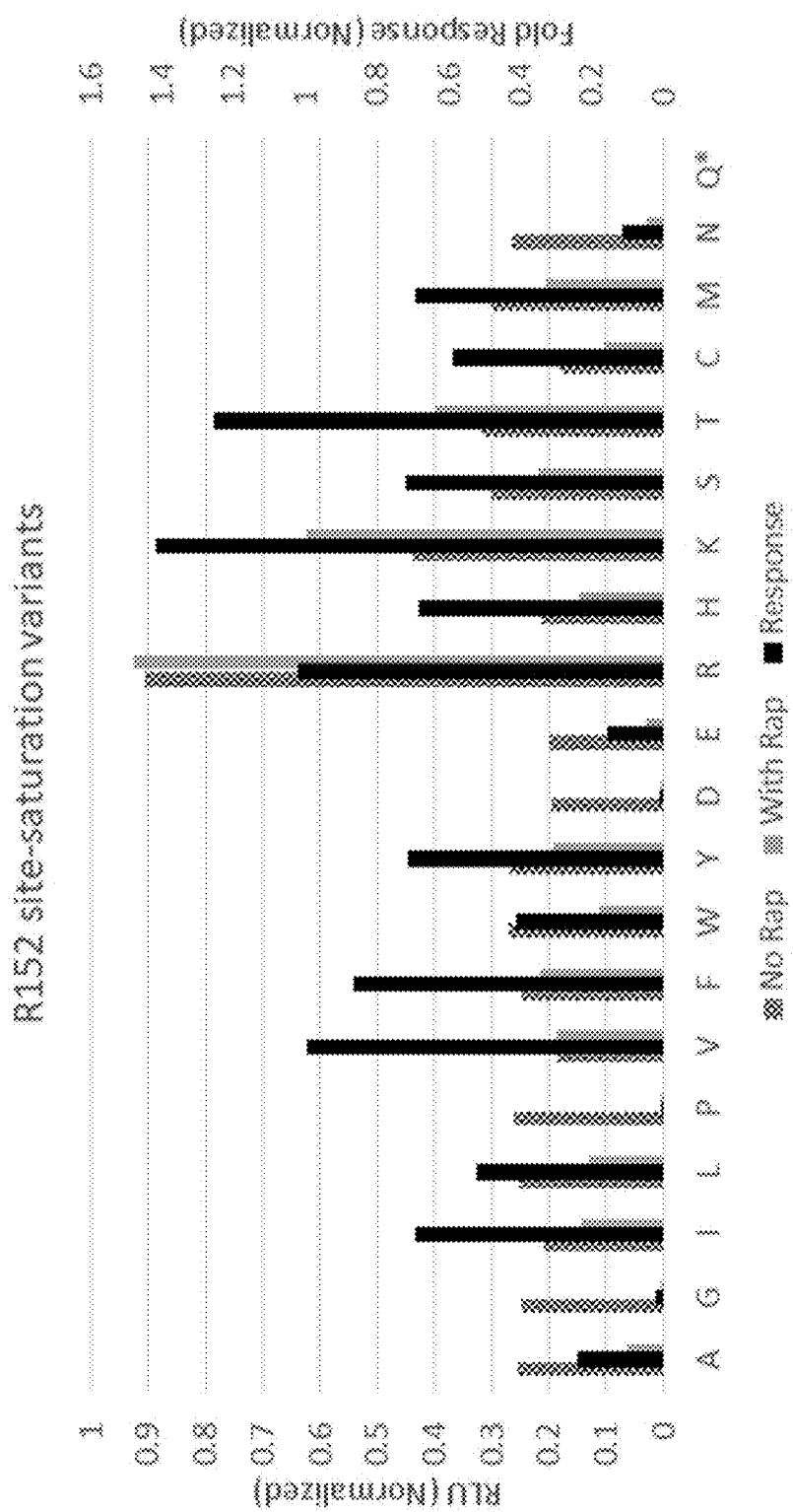
FIG. 105. Graph depicting a screen of SmTrip9 R152 site-saturation variants.
Figure 106:
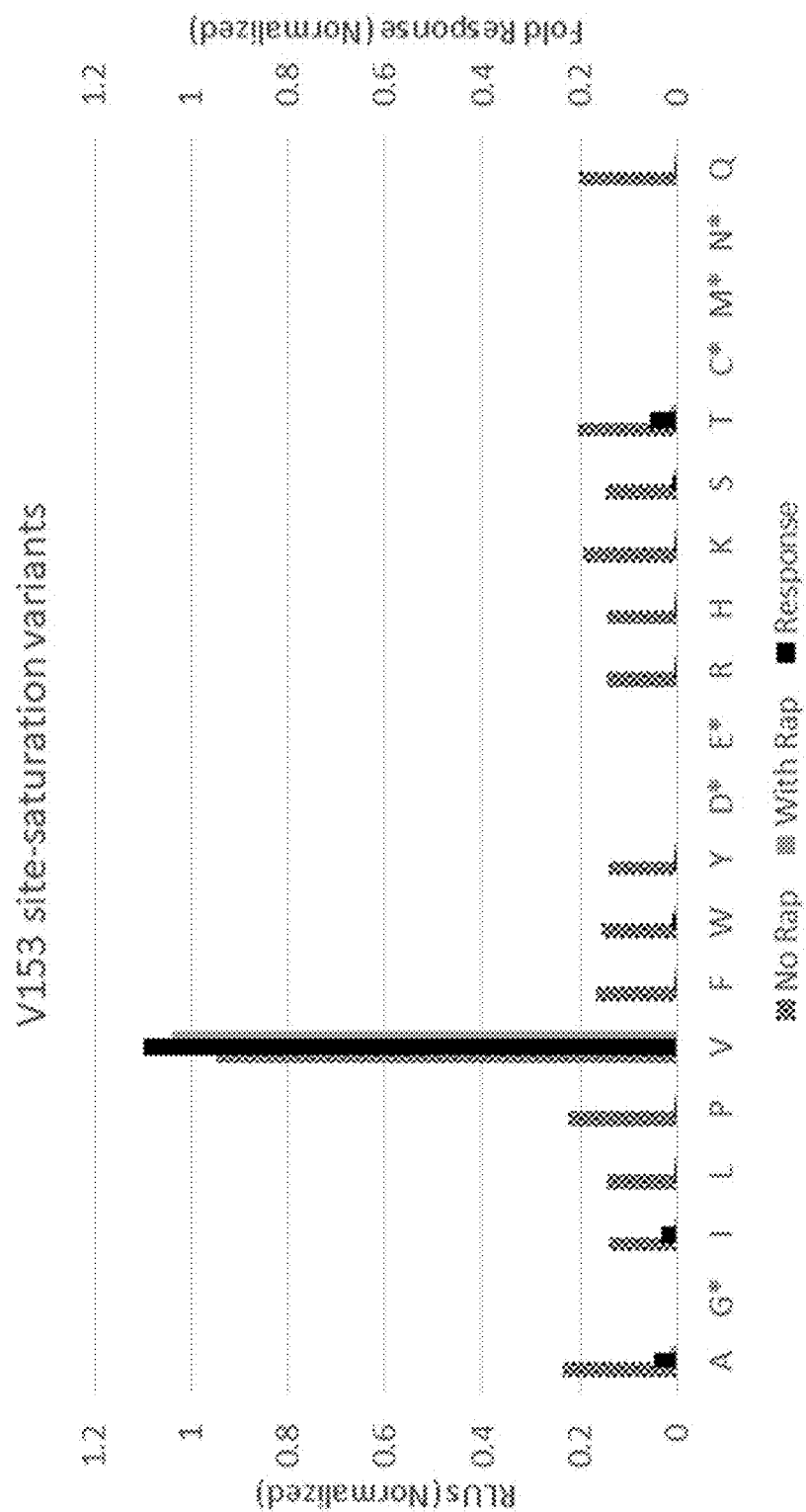
FIG. 106. Graph depicting a screen of SmTrip9 V153 site-saturation variants.
Figure 107:
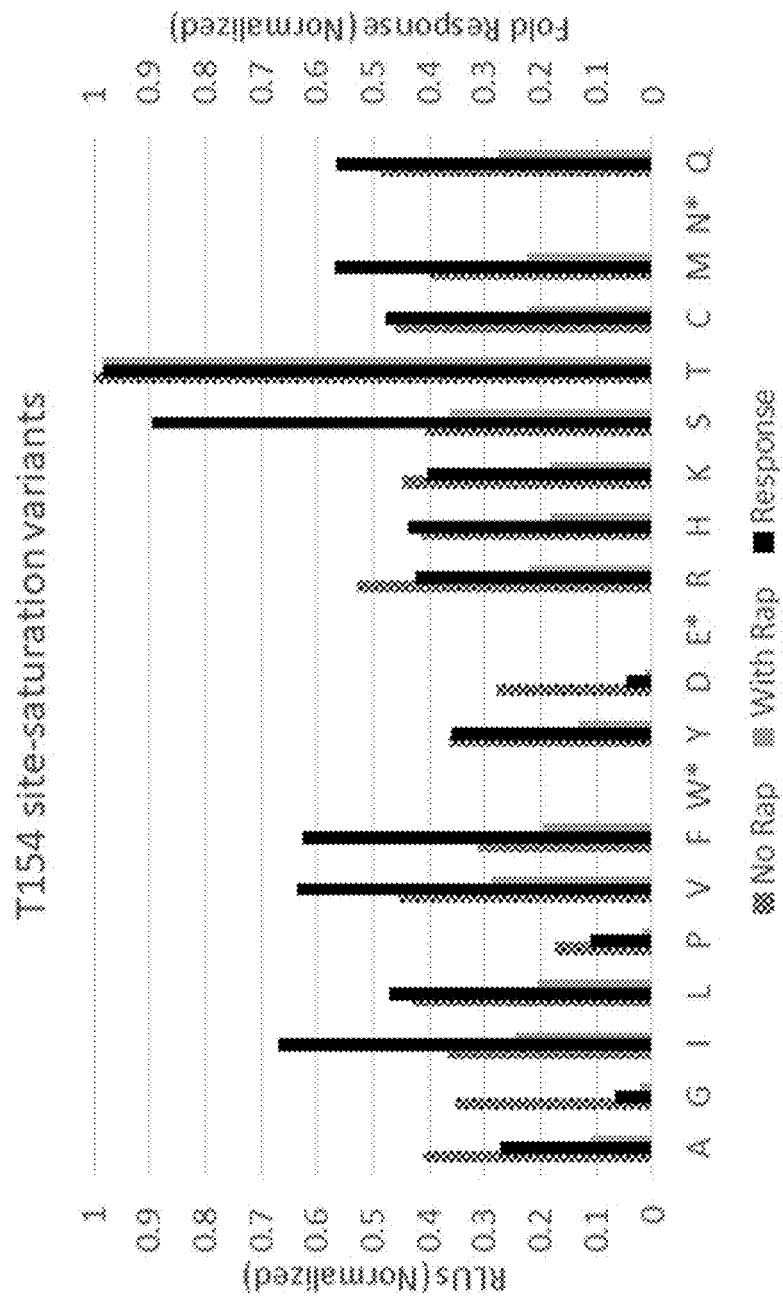
FIG. 107. Graph depicting a screen of SmTrip9 T154 site-saturation variants.
Figure 108:
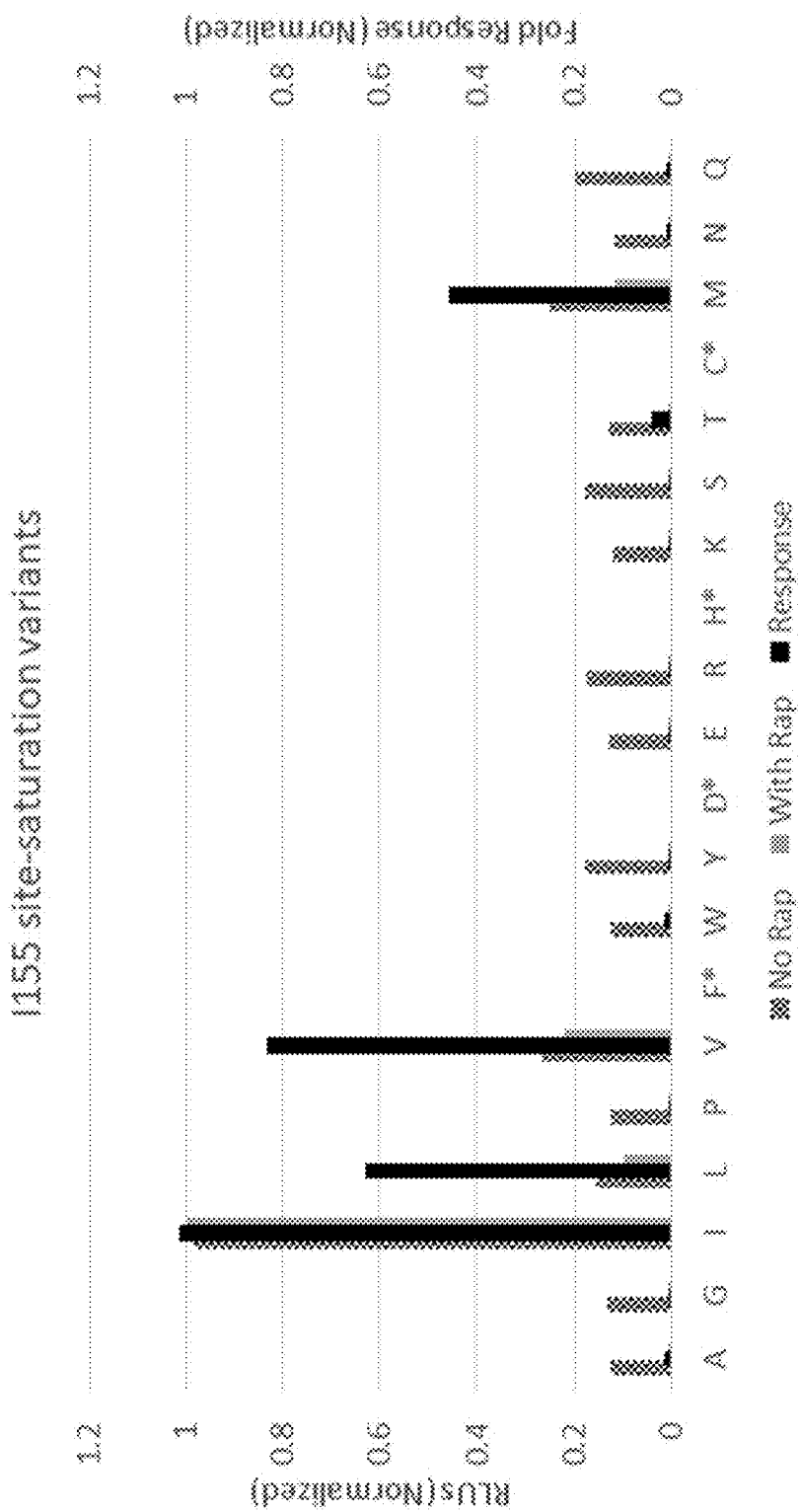
FIG. 108. Graph depicting a screen of SmTrip9 I155 site-saturation variants.
Figure 109:
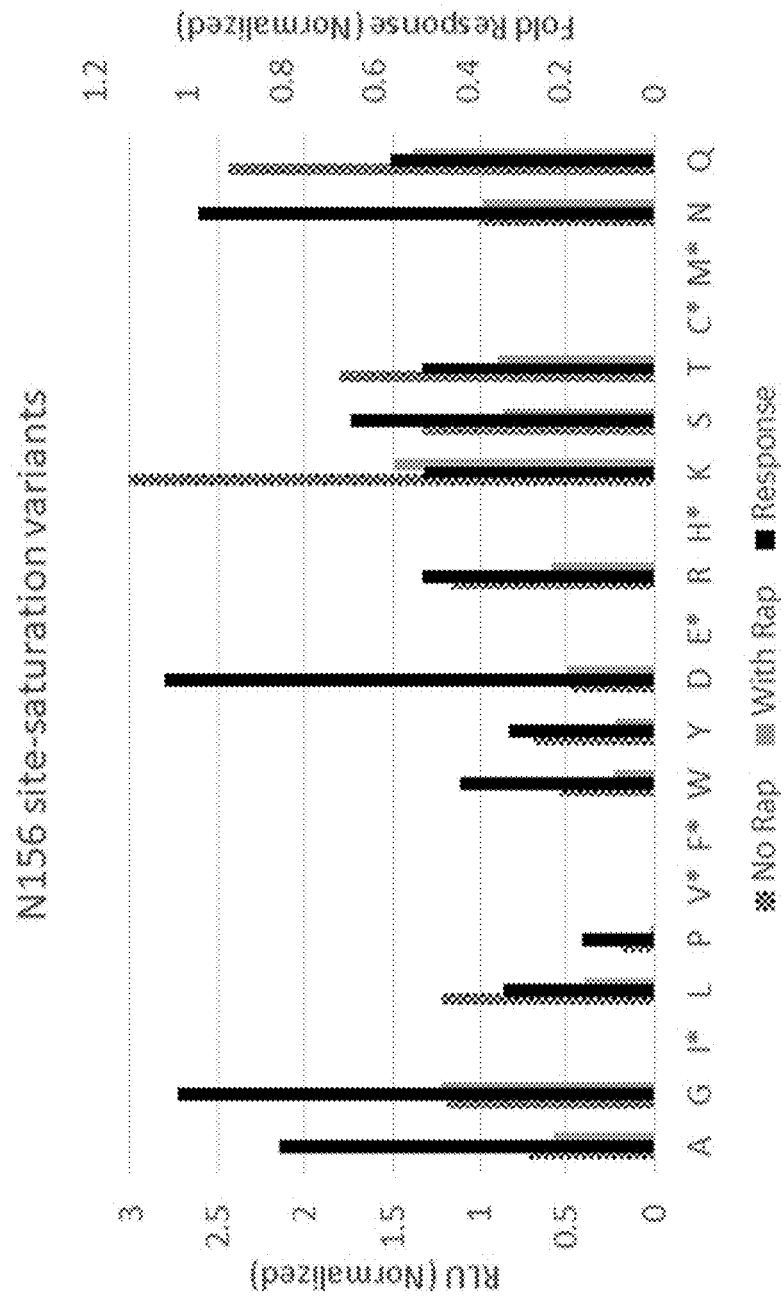
FIG. 109. Graph depicting a screen of SmTrip9 N156 site-saturation variants.
Figure 110:
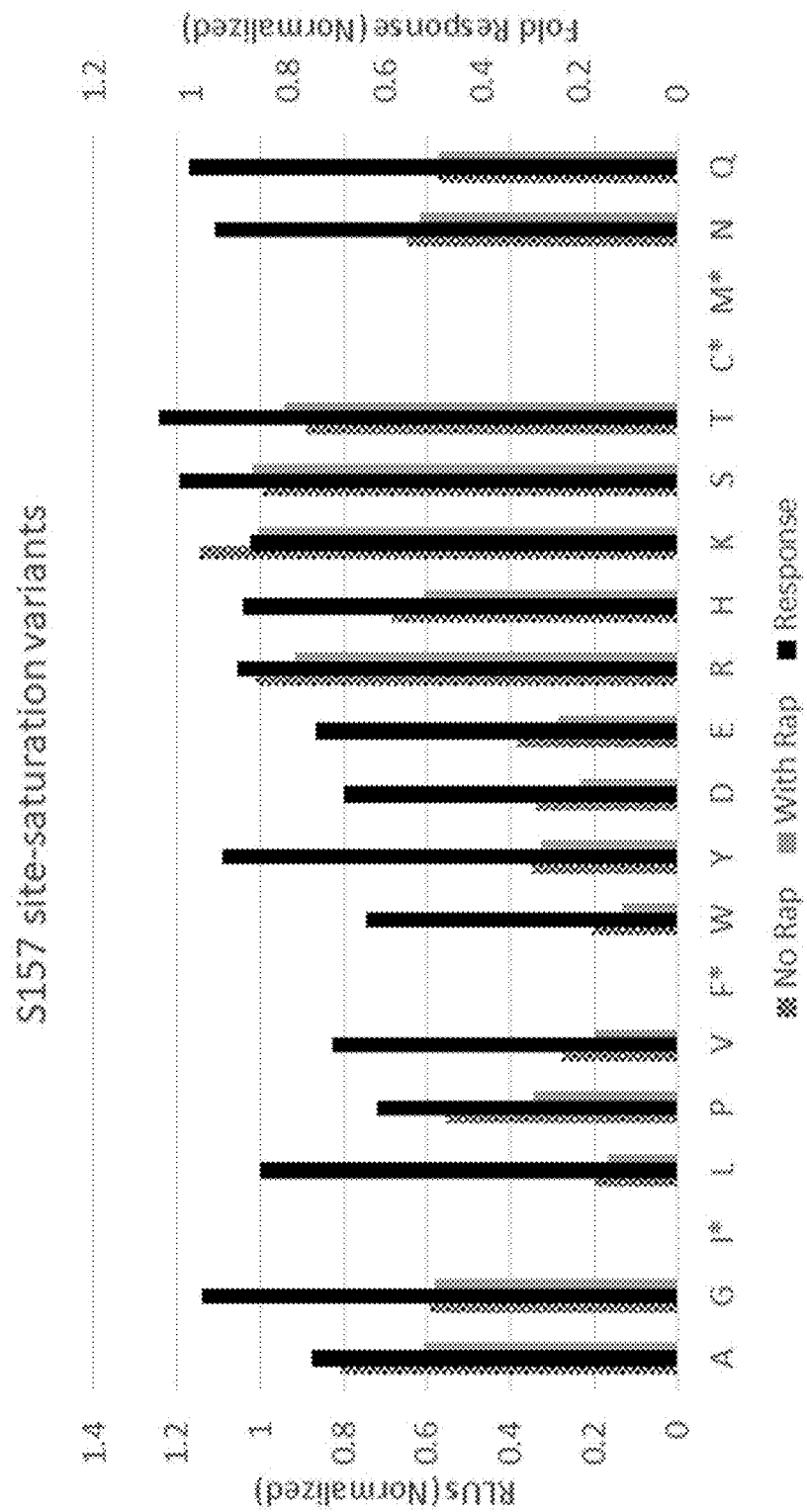
FIG. 110. Graph depicting a screen of SmTrip9 S157 site-saturation variants.
Figure 111:
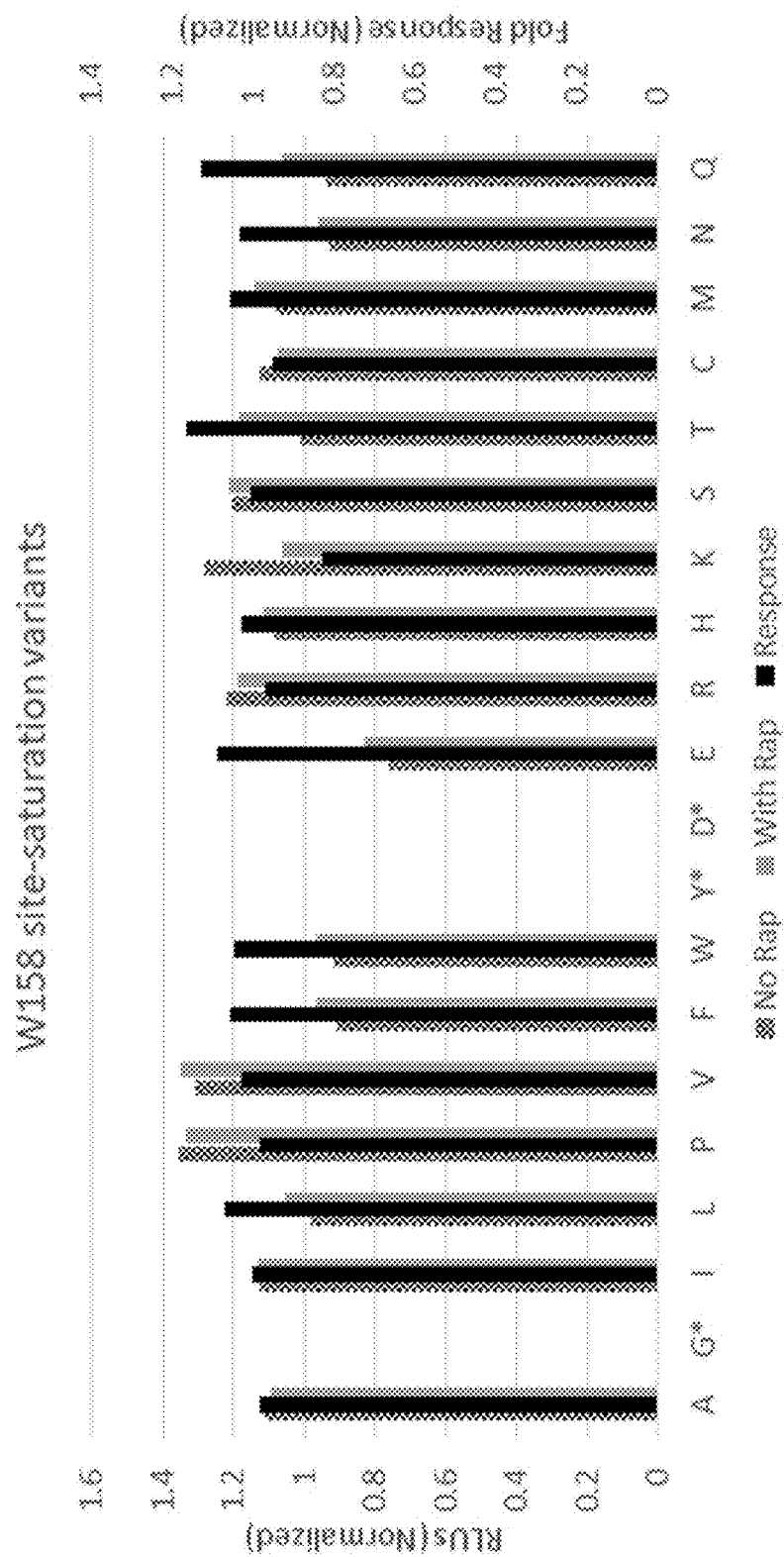
FIG. 111. Graph depicting a screen of SmTrip9 W158 site-saturation variants.
Figure 112:
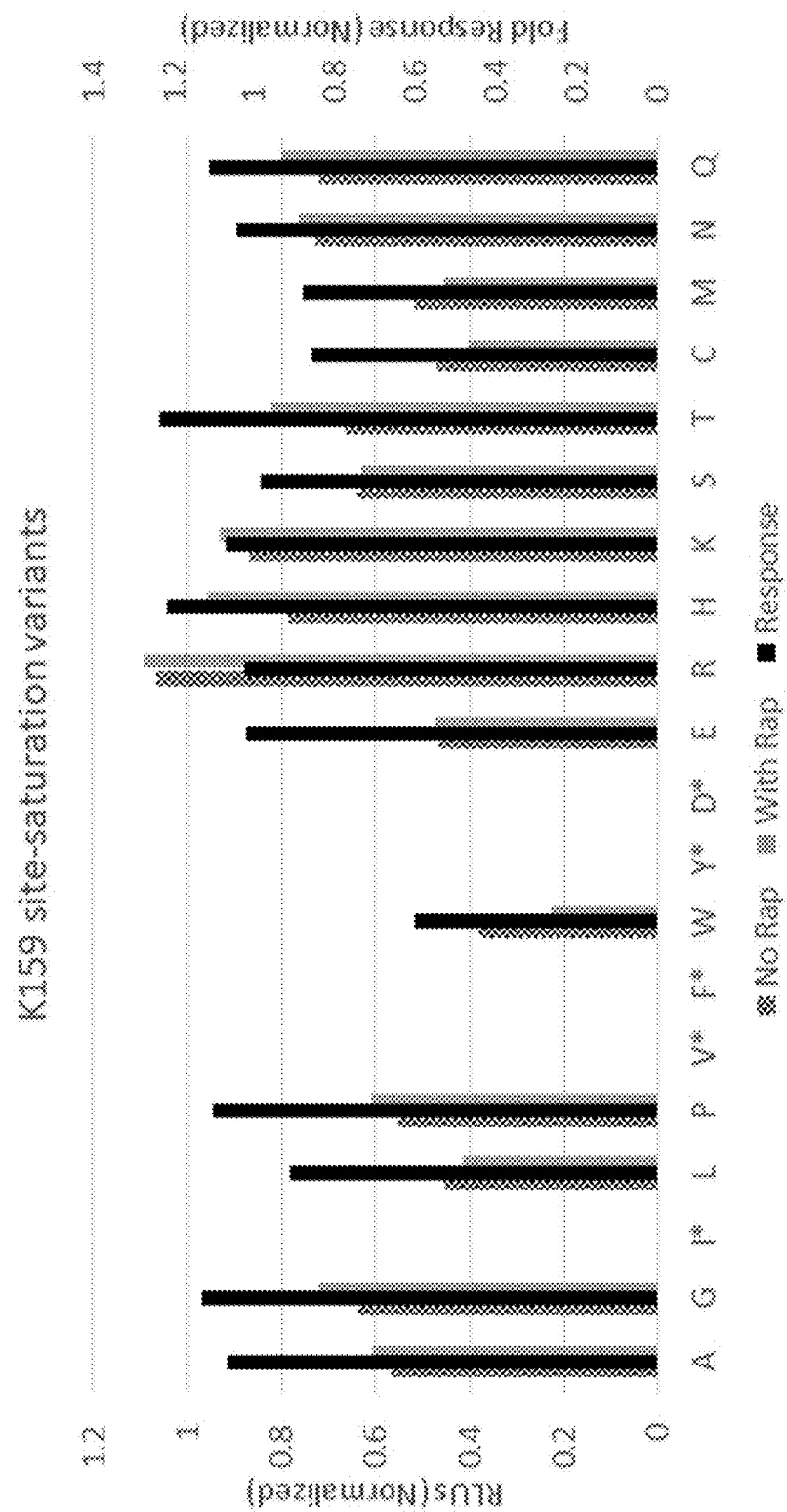
FIG. 112. Graph depicting a screen of SmTrip9 K149 site-saturation variants.

In some embodiments, a peptide/dipeptide/tripeptide tags (e.g., β6-like, β7-like, β8-like, β9-like (e.g., SmTrip9), and/or β10-like (e.g., SmTrip10) peptides, and/or dipeptides and tripeptides thereof) and a polypeptide component (e.g., β1-5-like, β1-6-like, β1-7-like, β1-8-like (e.g., LgTrip) polypeptide) is linked to an oligonucleotide recognition element or binding moiety. Such constructs may find use in nucleic acid (e.g., DNA, RNA, etc.) complementation and/or detection. Exemplary peptide/oligomer probes are depicted in FIG. 99. In such exemplary constructs, a peptide/dipeptide/tripeptide comprising a reactive group (e.g., azido group (e.g., N-terminal, C-terminal, internal, etc.) or other reactive group herein) is conjugated to an oligonucleotide comprising a complementary reactive group (e.g., alkyne group (e.g., 5'-terminal, 3'-terminal, interanl, etc.) or other reactive group herein). In an exemplary embodiment, peptide oligonucleotide probes are prepared by combing components and reagents (e.g., oligonucleotide (1 mg, 161 nmol, in water); triethylammonium acetate buffer (40 uL, 1M in water); aminoguanidine hydrochloride (8 uL, 50 mM in water); peptide (2.8 mg, 1.93 umol, in DMSO); copper(II) TBTA solution (10 mM in 1:1 water/DMSO); ascorbic acid solution (50 mM in water); final volume is 300 μL, 1:1 Water: DMSO); vortexing and heat for 30 min at 60° C.; filtering using Illustra NAP-5 column; exchanging buffer into TE buffer that is RNase and DNase free; and storing at −20° C. In embodiments, in which a molecular interaction is being monitored/detected, peptide/dipeptide/tripeptide tags and a polypeptide component are selected that have affinities for each other such that a significant increase in signal is detectable/measurable upon interaction (e.g., binding) of the associated first and second entities. In some embodiments, one or both (or more) peptide/dipeptide/tripeptide tags have sufficiently low affinity for the other peptide tag and/or the polypeptide component that only background luminescence is detected in the absence of the interaction (e.g., binding) between the associated first and second entities. In other embodiments, the peptide/dipeptide/tripeptide tags and polypeptide component will form a complex and produce a signal in the absence of interaction between the associated first and second entities, but the signal is increased (e.g., 2-fold, 3-fold, 4-fold, 5-fold, 6-fold, 7-fold, 8-fold, 9-fold, 10-fold, $10^2$-fold, $10^3$-fold, $10^4$-fold, $10^5$-fold, $10^6$-fold, or more or ranges there between) upon interaction (e.g., binding) of the associated first and second entities.

In embodiments in which a co-localization is being monitored/detected, peptide/dipeptide/tripeptide tags (e.g., β6-like, β7-like, β8-like, β9-like (e.g., SmTrip9), and/or β10-like (e.g., SmTrip10) peptides, and/or dipeptides and tripeptides thereof) and a polypeptide component (e.g., β1-5-like, β1-6-like, β1-7-like, β1-8-like (e.g., LgTrip) polypeptide) are selected that have affinities for each other, such that a signal from the luminescent complex is detectable/measurable even in the absence of an interaction (e.g., binding) of the associated first and second entities. In such embodiments, if the associated first and second entities co-localize (e.g., in the same tissue, in the same cell, in the same subcellular compartment, etc.), the peptide/dipeptide/tripeptide tags and polypeptide component will form a complex and emit a signal (in the presence of coelenterazine or a coelenterazine analog), whether or not the first and second entities interact with each other. In some embodiments, two or more (e.g., both, all) of the peptide/dipeptide/tripeptide tags have sufficiently high affinity for the other components that luminescence is detected in the absence of the interaction (e.g., binding) between the associated first and second entities. In some embodiments, no significant increase in signal is detected upon interaction of the first and second entities. In other embodiments, the peptide/dipeptide/tripeptide tags and polypeptide component will form a complex and produce a signal in the absence of interaction between the associated first and second entities, but the signal is increased (e.g., 2-fold, 3-fold, 4-fold, 5-fold, 6-fold, 7-fold, 8-fold, 9-fold, 10-fold, $10^2$-fold, $10^3$-fold, $10^4$-fold, $10^5$-fold, $10^6$-fold, or more or ranges there between) upon interaction (e.g., binding) of the associated first and second entities.

In some embodiments, peptide/dipeptide/tripeptide tags (e.g., β6-like, β7-like, β8-like, β9-like (e.g., SmTrip9), and/or β10-like (e.g., SmTrip10) peptides, and/or dipeptides and tripeptides thereof) and a polypeptide component (e.g., β1-5-like, β1-6-like, β1-7-like, β1-8-like (e.g., LgTrip) polypeptide) having known characteristics (e.g., spectral characteristics, mutual affinity, etc.) are used to elucidate the affinity of, or understand the interaction of, an interaction pair of interest. In other embodiments, a well-characterized interaction pair is used to determine the characteristics (e.g., spectral characteristics, mutual affinity, etc.) of one or more elements of a set of peptide/dipeptide/tripeptide tags and a polypeptide component. In some embodiments, peptide/dipeptide/tripeptide tags and a polypeptide component having known characteristics (e.g., spectral characteristics, mutual affinity, etc.) are used to characterize/monitor the co-localization of a co-localization par of interest (e.g., under desired conditions).

Embodiments described herein may find use in drug screening and/or drug development. For example, the interaction of a small molecule drug or an entire library of small molecules with a target protein of interest (e.g., therapeutic target) is monitored under one or more relevant conditions (e.g., physiological conditions, disease conditions, etc.).

Such an assay may comprise a first peptide/dipeptide/tripeptide tags (e.g., β6-like, β7-like, β8-like, β9-like (e.g., SmTrip9), and/or β10-like (e.g., SmTrip10) peptides, and/or dipeptides and tripeptides thereof) attached to a drug candidate (or a library of candidates) and a second peptide/dipeptide/tripeptide tags (e.g., β6-like, β7-like, β8-like, β9-like (e.g., SmTrip9), and/or β10-like (e.g., SmTrip10) peptides, and/or dipeptides and tripeptides thereof) attached to a therapeutic target; luminescence in the present of the polypeptide component (e.g., 11-5-like, β1-6-like, β1-7-like, β1-8-like (e.g., LgTrip) polypeptide) and substrate indicates interaction and/or co-localization of the candidate and target.

Some embodiments herein find use in the diagnostic or criminal setting for monitoring for drugs (e.g., drugs of abuse in human) as well as for therapeutic drug monitoring of patients in biological samples. For example, two peptide/dipeptide/tripeptide tagged binding moieties (e.g., binding moieties separately tagged with peptide/dipeptide/tripeptide tags (e.g., β6-like, β7-like, β8-like, β9-like (e.g., SmTrip9), and/or β10-like (e.g., SmTrip10) peptides, and/or dipeptides and tripeptides thereof) that recognize a drug analyte facilitate such embodiments. In some embodiments, a competitive dispalcement assay utilizing a peptide/dipeptide/tripeptide-tagged target in a system described herein to identify untagged target in a sample finds use in embodiments herein.

Some embodiments find use in detecting environmental contamination, for example, soil samples, water supply, etc. being contaminated by a specific drug or other specific contaminant (e.g., small molecule contaminant).

In other embodiments, the ability of a drug (e.g., small molecule drug) or an entire library of drugs (e.g., small molecules) to enhance or inhibit the interactions between two entities (e.g., receptor and ligand, protein-protein, etc.) is assayed (e.g., by gain or loss of the bioluminescent signal). In some embodiments, drug screening applications are carried out in a high through-put format to allow for the detection of the binding of thousands, or tens of thousands, of different molecules to a target, or to test the effect of those molecules on the binding of other entities.

In some embodiments, provided herein is the detection of molecular interactions in living organisms (e.g., bacteria, yeast, eukaryotes, mammals, primates, human, etc.) and/or cells. In some embodiments, pep peptide/dipeptide/tripeptide tags (e.g., β6-like, β7-like, β8-like, β9-like (e.g., SmTrip9), and/or β10-like (e.g., SmTrip10) peptides, and/or dipeptides and tripeptides thereof) fused to interaction (target) polypeptides are co-expressed in a cell or whole organism, and a signal is detected in the presence of a polypeptide component (e.g., β1-5-like, β1-6-like, β1-7-like, β1-8-like (e.g., LgTrip) polypeptide) and substrate (e.g., coelenterazine or coelenterazine analog), wherein the signal is correlated to the formation of the interaction complex. In some embodiments, cells are transiently and/or stably transformed or transfected with vector(s) coding for fusions comprising peptide tags and interaction elements. In some embodiments, CRISPR is utilized to generate cells that express fusions comprising peptide/dipeptide/tripeptide tags and interaction elements. In some embodiments, fusions (e.g., of a cellular target and a peptide/dipeptide/tripeptide or polypeptide described herein) generated by CRISPR replace endogenous protein (e.g., non-fused cellular target) and are regulated in a similar manner to endogenous protein. In some embodiments, such endogenous taging is used to monitor the level of the endogenously tagged protein, especially in complex systems such as live cells, whole organisms, etc. In some embodiments, transgenic organisms are generated that code for the necessary fusions (e.g., fusions comprising peptide tags and interaction elements) for carrying out the assays described herein. In other embodiments, vectors are injected into whole organisms.

In some embodiments, provided herein is the detection of molecular co-localization in living organisms (e.g., bacteria, yeast, eukaryotes, mammals, primates, human, etc.) and/or cells. In some embodiments, peptide/dipeptide/tripeptide tags (e.g., β6-like, β7-like, β8-like, β9-like (e.g., SmTrip9), and/or β10-like (e.g., SmTrip10) peptides, and/or dipeptides and tripeptides thereof) fused to co-localization (target) polypeptides are co-expressed in a cell or whole organism, and a signal is detected in the presence of a polypeptide component (e.g., β1-5-like, β1-6-like, β1-7-like, β1-8-like (e.g., LgTrip) polypeptide) and substrate (e.g., coelenterazine or coelenterazine analog), wherein the signal is correlated to the co-localization of the co-localization elements. In some embodiments, cells are transiently and/or stably transformed or transfected with vector(s) coding for fusions comprising peptide tags and co-localization elements. In some embodiments, CRISPR is utilized to generate cells that express fusions comprising peptide tags and co-localization elements. In some embodiments, transgenic organisms are generated that code for the necessary fusions (e.g., fusions comprising peptide tags and co-localization elements) for carrying out the assays described herein. In other embodiments, vectors are injected into whole organisms.

In certain embodiments, cells are engineered to express one or more peptide/dipeptide/tripeptide tags (e.g., β6-like, β7-like, β8-like, β9-like (e.g., SmTrip9), and/or β10-like (e.g., SmTrip10) peptides, and/or dipeptides and tripeptides thereof), polypeptide component (e.g., β1-5-like, β1-6-like, β1-7-like, β1-8-like (e.g., LgTrip) polypeptide), or fusions thereof (e.g., with cellular targets) using gene transfer technology or other engineering techniques. For example, the cells may be genetically engineered to express one or more peptide/dipeptide/tripeptide tags, polypeptide components, or fusions thereof (e.g., with cellular targets) using gene editing methodologies such as CRISPR (clustered regularly interspaced short palindromic repeat). The terms "CRISPR" or "CRISPR-Cas9," as used herein, refer to the various CRISPR-Cas9 and -CPF1 (and other) systems that can be programmed to target specific stretches of a genome and to edit DNA at precise locations. CRISPR-Cas9 gene editing systems are based on the RNA-guided Cas9 nuclease from the type II prokaryotic clustered regularly interspaced short palindromic repeats (CRISPR) adaptive immune system (see, e.g., Jinek et al., Science, 337: 816 (2012); Gasiunas et al, Proc. Natl. Acad. Set U.S.A., 109, E2579 (2012); Garneau et al., Nature, 468: 67 (2010); Deveau et al., Annu. Rev. Microbiol, 64: 475 (2010); Horvath and Barrangou, Science, 327: 167 (2010); Makarova et al., Nat. Rev. Microbiol., 9, 467 (2011); Bhaya et al., Annu. Rev. Genet., 45, 273 (2011); and Cong et al., Science, 339: 819-823 (2013); herein incorporated by reference in their entireties). CRISPR gene editing systems have been developed to enable targeted modifications to a specific gene of interest in eukaryotic cells (see, e.g., Cong et al., supra; Xiao-Jie et al., J. Med. Genet., 52(5): 289-96 (2015); U.S. Pat. No. 8,697,359; Xie et al., Genome Res., 24(9): 1526-1533 (2014); Huang et al., Stem Cells, 33(5): 1470-1479 (2015); Smith et al., Molecular Therapy, 23(3): 570-577 (2015); and U.S.

Patent Application Publication 2014/0068797; herein incorporated by reference in their entireties). Methods for utilizing CRISPR technology for gene editing are described in, for example, Barrangou et al., Science 315, 1709-1712 (2007); Bolotin et al., Microbiology, 151, 2551-2561 (2005); Brouns et al., Science 321, 960-964 (2008); Cong et al., supra; Deltcheva et al., Nature 471, 602-607 (2011); Gasiunas et al., supra; Hale et al., Cell 139, 945-956 (2009); Jinek et al., Science 337, 816-821 (2012); Makarova et al., Biology Direct 2006, 1:7 (2006); *Mali* et al., Science 339, 823-826 (2013); Marraffini et al., Science 322, 1843-1845 (2008); Mojica et al., J Mol Evol 60, 174-182 (2005); Pourcel et al., Microbiology 151, 653-663 (2005); and Sapranauskas et al., Nucl. Acids Res. 39, gkr606-gkr9282 (2011); herein incorporated by reference in their entireties.

In some embodiments, one or more peptide/dipeptide/tripeptide tags (e.g., β6-like, β7-like, β8-like, β9-like (e.g., SmTrip9), and/or β10-like (e.g., SmTrip10) peptides, and/or dipeptides and tripeptides thereof) are employed as a protein tag (e.g., within cells, within a whole animal). In such embodiments, the complement components to the peptide/dipeptide/tripeptide tag(s) (e.g., polypeptide components, the other peptide/dipeptide/tripeptide tag, substrate) are applied to the system (e.g., cells, animal, etc.) (e.g., as part of a reagent) to detect/quantify the presence of tagged proteins.

In some embodiments, the small size of the peptide tags herein (e.g., β9-like (e.g., SmTrip9) and β10-like (e.g., SmTrip10) peptides) is useful for protein tagging.

In some embodiments, the components of the bioluminescent complexes herein (e.g., peptide/dipeptide/tripeptide tags herein (e.g., β6-like, β7-like, β8-like, β9-like (e.g., SmTrip9), and/or β10-like (e.g., SmTrip10) peptides, and/or dipeptides and tripeptides thereof), polypeptide components (e.g., β1-5-like, β1-6-like, β1-7-like, β1-8-like (e.g., LgTrip) polypeptide) are stable enough to exist in a suitable buffer for extended periods of time (e.g., in the presence of coelenterazine or a coelenterazine analog (e.g., furimazine) substrate). In certain embodiments, components of the bioluminescent complexes herein (e.g., peptide/dipeptide/tripeptide tags, polypeptide components, etc.) exhibit minimal detectable luminescence in the absence of the complementing components (e.g., even in the presence of coelenterazine or coelenterazine analog (e.g., furimazine) substrate). In some embodiments, optimized buffer conditions are utilized to meet criteria necessary for protein tagging.

The compositions and methods provided herein, as well as any techniques or technologies based thereon find use in a variety of applications and fields.

Provided herein are methods for the design and/or optimization of peptide/dipeptide/tripeptide tags (e.g., β6-like, β7-like, β8-like, β9-like (e.g., SmTrip9), and/or β10-like (e.g., SmTrip10) peptides, and/or dipeptides and tripeptides thereof) and a polypeptide components (e.g., β1-5-like, β1-6-like, β1-7-like, β1-8-like (e.g., LgTrip) polypeptide), and the bioluminescent complexes that form therefrom. Any suitable method for the design of non-luminescent pairs/groups that are consistent with embodiments described herein, and/or panels thereof, is within the scope herein. In some embodiments, characteristics of peptide/dipeptide/tripeptide tags and polypeptide components, and combinations thereof are optimized by substitutions (e.g., substitution of natural amino acids, non-natural amino acids, amino acid analogs, etc.); such characteristics include, but are not limited to structural stability (e.g., of the peptide/dipeptide/tripeptide tag or polypeptide component, of a complex, etc.), expression, stickiness (e.g., to tubes, wells, etc.), brightness (or complexes formed therefrom), affinity for other components of the bioluminescent complex, solubility, thermal and chemical stability, low autoluminescence, etc.

In certain embodiments, peptide/dipeptide/tripeptide tags (e.g., β6-like, β7-like, β8-like, β9-like (e.g., SmTrip9), and/or β10-like (e.g., SmTrip10) peptides, and/or dipeptides and tripeptides thereof) and a polypeptide components (e.g., β1-5-like, β1-6-like, β1-7-like, β1-8-like (e.g., LgTrip) polypeptide) are designed de novo to lack luminescence individually and exhibit luminescence upon association. In such embodiments, the strength of the interaction between the non-luminescent elements is insufficient to produce a bioluminescent signal in the absence of interaction elements to facilitate formation of the bioluminescent complex. In other embodiments, peptide/dipeptide/tripeptide tags and polypeptide components and/or bioluminescent complexes thereof are rationally designed, for example, using a bioluminescent protein as a starting point. For example, such methods may comprise: (a) aligning the sequences of three or more related proteins; (b) determining a consensus sequence for the related proteins; (c) providing fragments (e.g., one or more peptides/dipeptides/tripeptides and a polypeptide) of a bioluminescent protein that is related to the ones from which the consensus sequence was determined, wherein the fragments are individually substantially non-luminescent but exhibit luminescence upon interaction of the fragments; and (d) testing the fragments for the absence of luminescence when unassociated and luminescence upon association of the non-luminescent pair. In some embodiments, the fragments are mutated at one or more positions (e.g., in vitro, in silico, etc.), wherein said mutations alter the sequences of the fragments and result in optimization of characteristics.

In some embodiments, a peptide/dipeptide/tripeptide tag is a 'dark peptide,' or one that forms a complex with the other peptide tag and polypeptide components (e.g., with low or high affinity), but produces minimal or no luminescence. In some embodiments, a high affinity dark peptide/dipeptide/tripeptide finds use in inverse complementation or gain of signal assays for biosensors or for measuring inhibitors. In some embodiments, a low affinity dark peptide/dipeptide/tripeptide is used to bring down background luminescence of a complex for the detection of binding of a high affinity bright peptide/dipeptide/tripeptide tag to the complex.

In some embodiments, a peptide/dipeptide/tripeptide tag is a 'quencher peptide,' or one that contains a quencher moiety (e.g., DAB), and the quencher absorbs the light/energy produced by either or both of a polypeptide component (e.g., the signal produced independent of a complementing peptide/dipeptide/tripeptide tags) and/or bioluminescent complex.

In some embodiments, the luminescent complexes herein find use in systems, methods, assays, devices, etc. that utilize BRET between the complex and a fluorophore (e.g., small molecule fluorophore, fluorescent protein (e.g., cyOFP)). In some embodiments, a fluorophore (e.g., small molecule fluorophore, fluorescent protein (e.g., cyOFP)) is linked or fused to an analyte, cellular target, etc. In some embodiments, a fluorophore (e.g., small molecule fluorophore, fluorescent protein (e.g., cyOFP)) is linked or fused to a peptide/dipeptide/tripeptide tag and/or polypeptide component. In some embodiments, energy is transferred from a bioluminescent complex to an energy acceptor. In certain embodiments, an energy acceptor is a fluorophore or other detectable chromophore. Suitable fluorophores include, but are not limited to: xanthene derivatives (e.g., fluorescein, rhodamine, Oregon green, eosin, Texas red, etc.), cyanine derivatives (e.g., cyanine, indocarbocyanine, oxacarbocyanine, thiacarbocyanine, merocyanine, etc.), naphthalene derivatives (e.g., dansyl and prodan derivatives), oxadiazole derivatives (e.g., pyridyloxazole, nitrobenzoxadiazole, benzoxadiazole, etc.), pyrene derivatives (e.g., cascade blue), oxazine derivatives (e.g., Nile red, Nile blue, cresyl violet, oxazine 170, etc.), acridine derivatives (e.g., proflavin, acridine orange, acridine yellow, etc.), arylmethine derivatives (e.g., auramine, crystal violet, malachite green, etc.), tetrapyrrole derivatives (e.g., porphin, phtalocyanine, bilirubin, etc.), CF dye (Biotium), BODIPY (Invitrogen), ALEXA FLOUR (Invitrogen), DYLIGHT FLUOR (Thermo Scientific, Pierce), ATTO and TRACY (Sigma Aldrich), Fluo-Probes (Interchim), DY and MEGASTOKES (Dyomics), SULFO CY dyes (CYANDYE, LLC), SETAU AND SQUARE DYES (SETA BioMedicals), QUASAR and CAL FLUOR dyes (Biosearch Technologies), SURELIGHT DYES (APC, RPE, PerCP, Phycobilisomes)(Columbia Biosciences), APC, APCXL, RPE, BPE (Phyco-Biotech), autofluorescent proteins (e.g., YFP, RFP, mCherry, mKate), quantum dot nanocrystals, etc. In some embodiments, a fluorophore is a rhodamine analog (e.g., carboxy rhodamine analog), such as those described in U.S. patent application Ser. No. 13/682,589, herein incorporated by reference in its entirety. In some embodiments, a fluorophore is a small molecule fluorophore; embodiments herein reciting a fluorophore may be read as or limited to a small molecule fluorophore. In some embodiments, a fluorophore is a fluorescent protein (e.g., cyOFP, GFP, CFP, etc.; embodiments herein reciting a fluorophore may be read as or limited to a fluorescent protein (e.g., cyOFP, GFP, CFP, etc.).

In various embodiments, the bioluminescent complexes described herein, and components thereof, find use in a variety of different immunoassay concepts. For example, in some embodiments, a peptide/dipeptide/tripeptide tags (e.g., β6-like, β7-like, β8-like, β9-like (e.g., SmTrip9), and/or β10-like (e.g., SmTrip10) peptides, and/or dipeptides and tripeptides thereof) is tethered/fused to a primary or secondary antibody to provide a method of detection for a particular analyte. As another example, a peptide tag is tethered/fused to an antibody-binding protein (e.g., protein A or protein G) and used to detect a specific antibody bound to a particular analyte (e.g., wherein the analyte is bound to the complementary peptide tag). As another example, a peptide/dipeptide/tripeptide tag is tethered/fused to streptavidin and used to detect a specific biotinylated antibody bound to a particular analyte (e.g., wherein the analyte is bound to the complementary peptide tag). As yet another example, peptide/dipeptide/tripeptide tags are tethered/fused to primary and secondary antibodies, where the primary antibody recognizes a particular analyte, and the secondary antibody recognizes the primary antibody. As still another example, a peptide/dipeptide/tripeptide tag is tethered/fused to an analyte and used in a competitive sandwich ELISA format. A peptide/dipeptide/tripeptide tag is tethered/fused conjugated to an analyte may also be used to detect antibodies capable of binding the analyte.

Various embodiments herein find use in small molecule detection via immunoassay. Exemplary embodiments comprise the use of a small molecule directly (e.g., identical or similar to the target small molecule) labeled with a first peptide/dipeptide/tripeptide described herein and a binding moiety for the target small molecule fused or linked to a peptide/dipeptide/tripeptide described herein. In the presence of polypeptide component and substrate (e.g., coelenterazine or coelenterazine analog), a bioluminescent signal is produced by the system. When the system is exposed to a sample (e.g., biological sample, environmental sample, etc.), the bioluminescent signal will be reduced if the small molecule target is present in the sample (the labeled small molecule will be competed out of the complex allowing, in some cases, quantitation of the small molecule target). Alternative configurations for such assays are also within the scope herein. In some embodiments, the target small molecule is a toxin (e.g., mycotoxin, etc.), metabolite (e.g., amino acid, glucose molecule, fatty acid, nucleotide, cholesterol, steroid, etc.), vitamin (e.g., vitamin A, vitamin B1, vitamin B2, Vitamin B3, vitamin B5, vitamin B7, vitamin B9, vitamin B12, vitamin C, vitamin D, vitamin E, vitamin H or vitamin K, etc.), coenzyme or cofactor (e.g., coenzyme A, coenzyme B, coenzyme M, coenzyme Q, cytidine triphosphate, acetyl coenzyme A, reduced nicotinamide adenine dinucleodtide (NADH), nicotinamide adenine (NAD+), nucleotide adenosine monophosphoate, nucleotide adenosine triphosphate, glutathione, heme, lipoamide, molybdopterin, 3'-phosphoadenosine-5'-phsphosulfate, pyrroloquinoline quinone, tetrahydrobiopterin, etc.), biomarker or antigen (e.g., erythropoietin (EPO), ferritin, folic acid, hemoglobin, alkaline phosphatase, transferrin, apolipoprotein E, CK, CKMB, parathyroid hormone, insulin, cholesteryl ester transfer protein (CETP), cytokines, cytochrome c, apolipoprotein AI, apolipoprotein AII, apolipoprotein BI, apolipoprotein B-100, apolipoprotein B48, apolipoprotein CII, apolipoprotein CIII, apolipoprotein E, triglycerides, HD cholesterol, LDL cholesterol, lecithin cholesterol acyltransferase, paraxonase, alanine aminotransferase (ALT), asparate transferase (AST), CEA, HER-2, bladder tumor antigen, thyroglobulin, alpha-fetoprotein, PSA, CA 125, CA 19.9, CA 15.3, leptin, prolactin, osteoponitin, CD 98, fascin, troponin I, CD20, HER2, CD33, EGFR, VEGFA, etc.), drug (cannabinoid (e.g., tetrahydrocannabinol (THC), cannabidiol (CBD) and cannabinol (CBN), etc.), opioid (e.g., heroin, opium, fentanyl, etc.), stimulant (e.g., cocaine, amphetamine, methamphetamine, etc.), club drug (e.g., MDMA, flunitrazepam, gama-hydroxybutyrate, etc.), dissociative drug (e.g., ketamine, phencyclidine, salvia, dextromethorphan, etc.), hallucinogens (e.g., LSD, mescaline, psilocybin, etc.), etc.), explosive (e.g., 2,4,6-trinitrotoluene (TNT) and hexahydro-1,3,5-trinitro-1,3,5-triazine (RDX), pentaerythritol tetranitrate (PETN), etc.), toxic chemical (e.g., tabun (GA), sarin (GB), soman (GD), cyclosarin (GF), 2-(dimethylamino)ethyl N, N-dimethylphosphoramidofluroidate (GV), VE, VG, VM, VP, VR, VS, or VX nerve agent), etc.

The systems and methods described herein find use in a wide variety of applications and formats. The following are non-exhaustive exemplary examples of methods and formats utilizing the systems described herein.

Figure 51A:
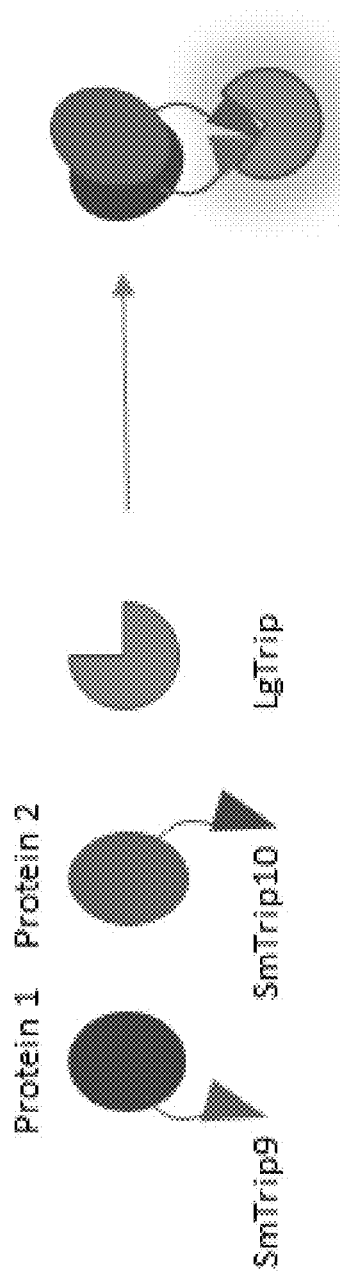
FIG. 51A-D. Schematic illustrations depicting exemplary protein-protein interaction assays or analyte detection assays using binding moieties tagged with peptides.

In some embodiments, provided herein are intracellular two protein systems for dynamic protein-protein interaction analysis with SmTrip peptide-labeled proteins expressed as fusions via traditional transfection or endogenously tagged proteins via CRISPR; LgTrip can be used as a detection reagent either by co-transfection, of LgTrip, providing a stable cell line expressing LgTrip, or providing LgTrip in the detection reagent and adding it to lysed cells expressing SmTrip-labeled proteins.(FIG. 51A).

Figure 51B:
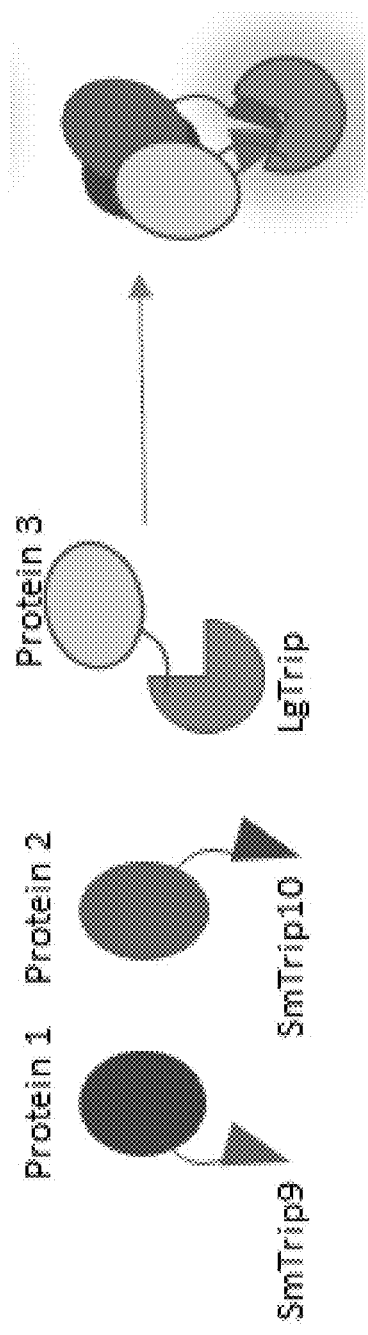

In some embodiments, provided herein are intracellular three protein systems for dynamic protein-protein interaction analysis with SmTrip- and LgTrip-labeled proteins expressed as fusions via traditional transfection or as endogenously-tagged proteins generated via CRISPR (FIG. 51B).

Figure 51C:
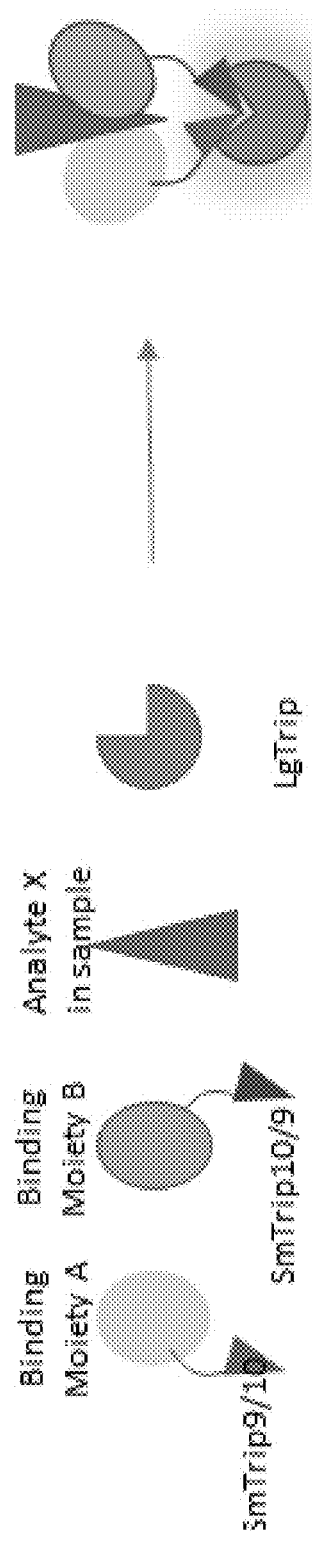

In some embodiments, provided herein are target specific assays to measure analyte X with binding moiety A and binding moiety B (See Table A; purified genetic fusions or chemically conjugated SmTrip9 or SmTrip10 peptide) for a gain of signal assay (e.g. diagnostic test, non-cellular, etc.) (FIG. 51C).

Figure 51D:
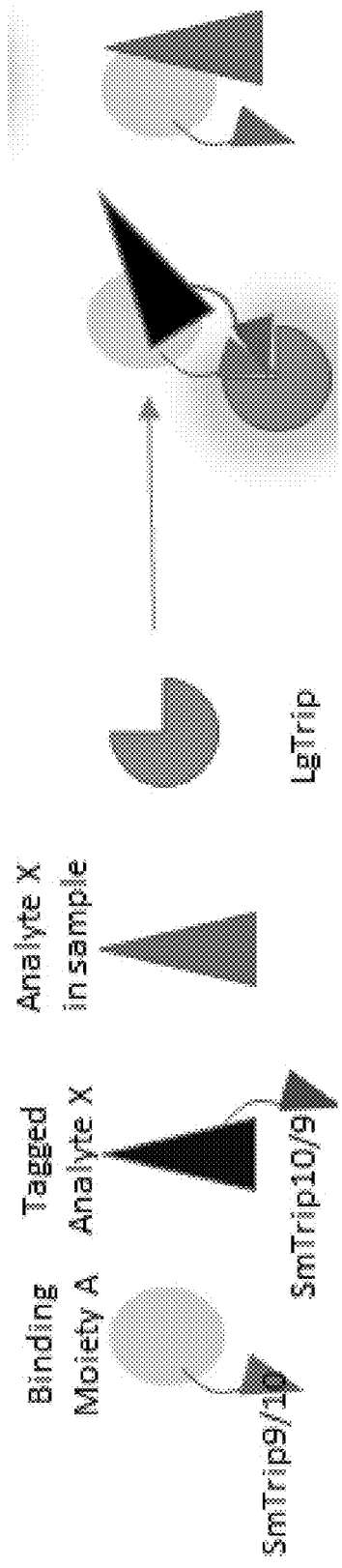

In some embodiments, provided herein are target specific competition assays for analyte measurement through loss of signal (e.g. diagnostic test, noncellular, etc.) (FIG. 51D). Such a system use a purified binding moiety A (e.g., purified genetic fusion or chemically conjugated comprising synthetic SmTrip9 or SmTrip10 peptide) that binds the tagged target analyte to generate light in the presence of LgTrip and a coelenterazine substrate or coelenterazine analog, which may be provided as part of a detection reagent. In the presence of sample analyte X, SmTrip9 or SmTrip10 peptide will compete with the sample analyte X to cause a loss of signal specific to the presence of the sample analyte in the sample and proportional to the concentration of the analyte.

In some embodiments, two or three of the peptide tags peptide/dipeptide/tripeptide tags (e.g., β6-like, β7-like, β8-like, β9-like (e.g., SmTrip9), and/or β10-like (e.g., SmTrip10) peptides, and/or dipeptides and tripeptides thereof) and polypeptide components (e.g., β1-5-like, β1-6-like, β1-7-like, β1-8-like (e.g., LgTrip) polypeptide) are linked (or fused) to recognition elements for proximal, but non-overlapping (mutually exclusive or distinct), epitopes on the same target analyte. A signal generated from the luminescent complex (e.g., in the presence of a substrate) indicates the presence of the target analyte.

In some embodiments, the peptide/dipeptide/tripeptide tags (e.g., β6-like, β7-like, β8-like, β9-like (e.g., SmTrip9), and/or β10-like (e.g., SmTrip10) peptides, and/or dipeptides and tripeptides thereof) and polypeptide components (e.g., β1-5-like, β1-6-like, β1-7-like, β1-8-like (e.g., LgTrip) polypeptide) herein find use in immunoassays or various formats. Immunoassays employing the peptide/dipeptide/tripeptide tags and polypeptide components herein are not limited to full length antibodies and may also employ antibody fragments or non-antibody binding moieties (e.g., DARPins, aptamers, affimers, etc.). In an exemplary direct immunoassay (See, e.g., FIG. 51E), two monoclonal or recombinant antibodies (mAbs or rAbs) against an analyte are labeled with β9-like (e.g., SmTrip9) and β10-like (e.g., SmTrip10) peptide tags; a polypeptide component (e.g., β1-8-like (e.g., LgTrip) polypeptide) of the luminescent complex is included as part of detection reagent (e.g., with substrate). For an exemplary indirect immunoassay (See, e.g., FIG. 51F), generic reagents labeled with β9-like (e.g., SmTrip9) and β10-like (SmTrip10) peptide tags are used in combination with any paired antibody system specific to an analyte (e.g., mAb or rAb +Biotin-pAb, Biotin-mAb, or Biotin-rAb etc.); a polypeptide component of the luminescent complex is included as part of detection reagent (e.g., with substrate). An exemplary competition direct immunoassay (See, e.g., FIG. 51G) is provided by labeling one antibody with a first peptide tag (β9-(e.g, SmTrip9) or β10-like (e.g., SmTrip10) peptide) and labeling a analyte with a second peptide tag (β10-(e.g., SmTrip10) or β9-like (e.g., SmTrip9) peptide); a polypeptide component (e.g., β1-8-like (e.g., LgTrip) polypeptide) of the luminescent complex is included as part of detection reagent (e.g., with substrate); loss of signal indicates the presence of unlabeled target analyte. To provide a competition indirect immunoassay (See, e.g., FIG. 51H), one antibody is labeled with a first peptide tag (β9-(e.g., SmTrip9) or β10-like (e.g., SmTrip10) peptide), a generic binding reagent (e.g., streptavidin) is labeled with a second peptide tag ((310-(e.g., SmTrip10) or $β_9$-like (e.g., SmTrip9) peptide), and analyte is labeled with a binding moiety for the generic binding reagent (e.g., biotin); a polypeptide component of the luminescent complex is included as part of detection reagent (e.g., with substrate); loss of signal indicates the presence of unlabeled test analyte. Alternative immunoassays utilizing other peptide/dipeptide/tripeptide/polypeptide combinations described herein are within the scope of the present invention.

In some embodiments, provided herein are homogeneous assays using peptide/dipeptide/tripeptide tag-labelled (e.g., β6-like, β7-like, β8-like, β9-like (e.g., SmTrip9), and/or β10-like (e.g., SmTrip10) peptides, and/or dipeptides and tripeptides thereof) recognition elements with the polypeptide component (e.g., β1-5-like, $β_{1-6}$-like, β1-7-like, β1-8-like (e.g., LgTrip) polypeptide) as component of a detection reagent (e.g., along with a substrate for the luminescent complex).

In some embodiments, provided herein are homogeneous assays utilizing peptide/dipeptide/tripeptide-tag-labelled (e.g., SmTrip9, SmTrip10, etc.) and/or polypeptide-component-labelled (e.g., LgTrip variants) recognition elements. In some embodiments, homogeneous assays are provided for detection/quantification of a single analyte or multiple analytes.

In some embodiments, the peptide/dipeptide/tripeptide tags (e.g., β6-like, β7-like, 18-like, β9-like (e.g., SmTrip9), and/or β10-like (e.g., SmTrip10) peptides, and/or dipeptides and tripeptides thereof) and polypeptide components (e.g., β1-5-like, β1-6-like, β1-7-like, β1-8-like (e.g., LgTrip) polypeptide) herein find use in sandwich hybridization assays (e.g. non-target amplified, amplified, etc.).

In some embodiments, the peptide/dipeptide/tripeptide tags (e.g., β6-like, β7-like, β8-like, β9-like (e.g., SmTrip9), and/or β10-like (e.g., SmTrip10) peptides, and/or dipeptides and tripeptides thereof) and polypeptide components (e.g., β1-5-like, β1-6-like, β1-7-like, β1-8-like (e.g., LgTrip) polypeptide) herein find use in the detection of analyte(s) in liquid/solution phase or solid phase.

In some embodiments, the peptide/dipeptide/tripeptide tags (e.g., $β_6$-like, $β_7$-like, β8-like, β9-like (e.g., SmTrip9), and/or β10-like (e.g., SmTrip10) peptides, and/or dipeptides and tripeptides thereof) and polypeptide components (e.g., β1-5-like, β1-6-like, β1-7-like, β1-8-like (e.g., LgTrip) polypeptide) herein find use in surface-based assays (e.g., plate-based (e.g., microtiter plate), paper-based (e.g., Whatman protein saver 903 cards), plastic-based, swab-based, cuvette-based, membrane-based (e.g., PVDF, nitrocellulose, etc.), etc.

In some embodiments, the peptide/dipeptide/tripeptide tags (e.g., β6-like, β7-like, β8-like, $β_9$-like (e.g., SmTrip9), and/or β10-like (e.g., SmTrip10) peptides, and/or dipeptides and tripeptides thereof) and polypeptide components (e.g., β1-5-like, β1-6-like, β1-7-like, β1-8-like (e.g., LgTrip) polypeptide) herein find use in lateral flow and other capillary driven based methods. In some embodiments, such lateral flow assays allow multiplexed detection/identification/characterization of analytes (e.g., pathogens). In some embodiments, lateral flow assays find use in performing immunoassays described herein.

Figure 52:
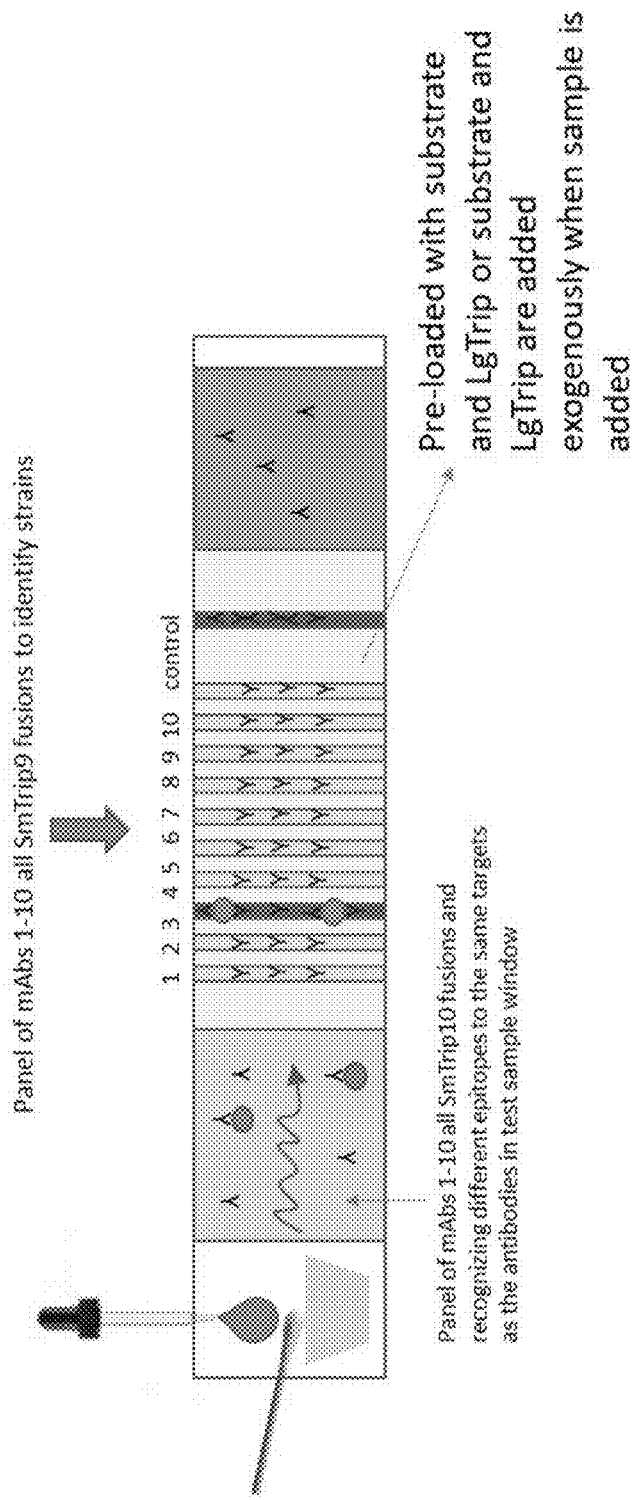
FIG. 52. Schematic illustration of an exemplary multiplexed tripartite lateral flow assay. Such an assay finds use, for example, in the detection of pathogens.

An exemplary multiplexed tripartite lateral flow assay for the detection and identification of pathogens using tripartite antibody fusions in a direct immunoassay is depicted in FIG. 52. In this example, a set of monoclonal or recombinant antibodies (mAbs or rAbs), each fused to a peptide tag (e.g., β10-like (e.g., SmTrip10) peptides) are added to a liquid sample, the sample is passed over a detection window comprising a second set of mAbs or rAbs, each fused to a peptide tag (e.g., β9-like (e.g., SmTrip9) peptides), immobilized in lanes within the detection window, and each recognizing a distinct epitope on the same target as one of the mAbs or rAbs in the liquid sample. When the liquid sample is passed through the detection window in the presence of a polypeptide component and substrate (e.g., preloaded in the detection window, added with the sample, added separately to the device, etc.), luminescence in a particular lane indicates the binding of mAbs or rAbs to separate epitopes on a target, and thereby provide for detection and identification of the target. The above described assay, and alternatives thereof utilizing the systems and methods herein, may find use in providing various detection panels (e.g., Respiratory Panel: *Streptococcus, Pseudomonas, Mycobacterium, Staphylococcus*; Urinary Tract Panel: *E. Coli, Klebsiella, Enterobacter, Streptococcus*; Food Borne Panel: *Shigella, Campylobacter, Salmonella, E. Coli, Listeria*; Waste Water Management: Coliform panel; Panel for strain identification within one type of bacteria; etc.), as well as for other applications (e.g., toxin detection).

Figure 53:
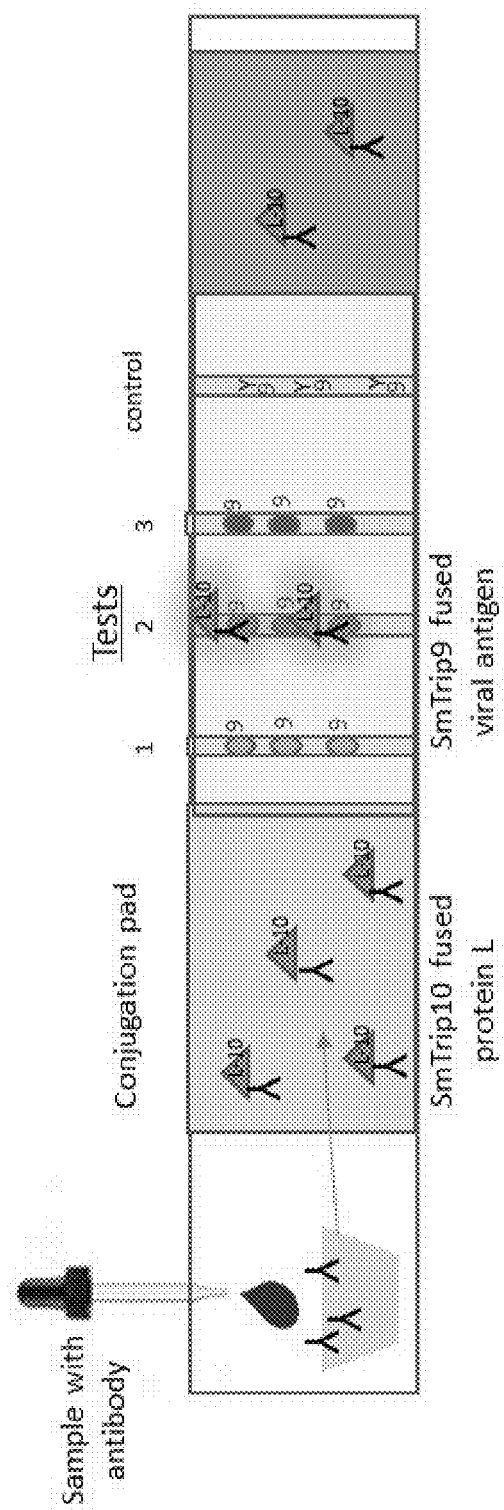
FIG. 53. Schematic illustration of an exemplary multiplexed tripartite lateral flow assay. Such an assay finds use, for example, in the detection of antiviral antibodies.
Figure 54:
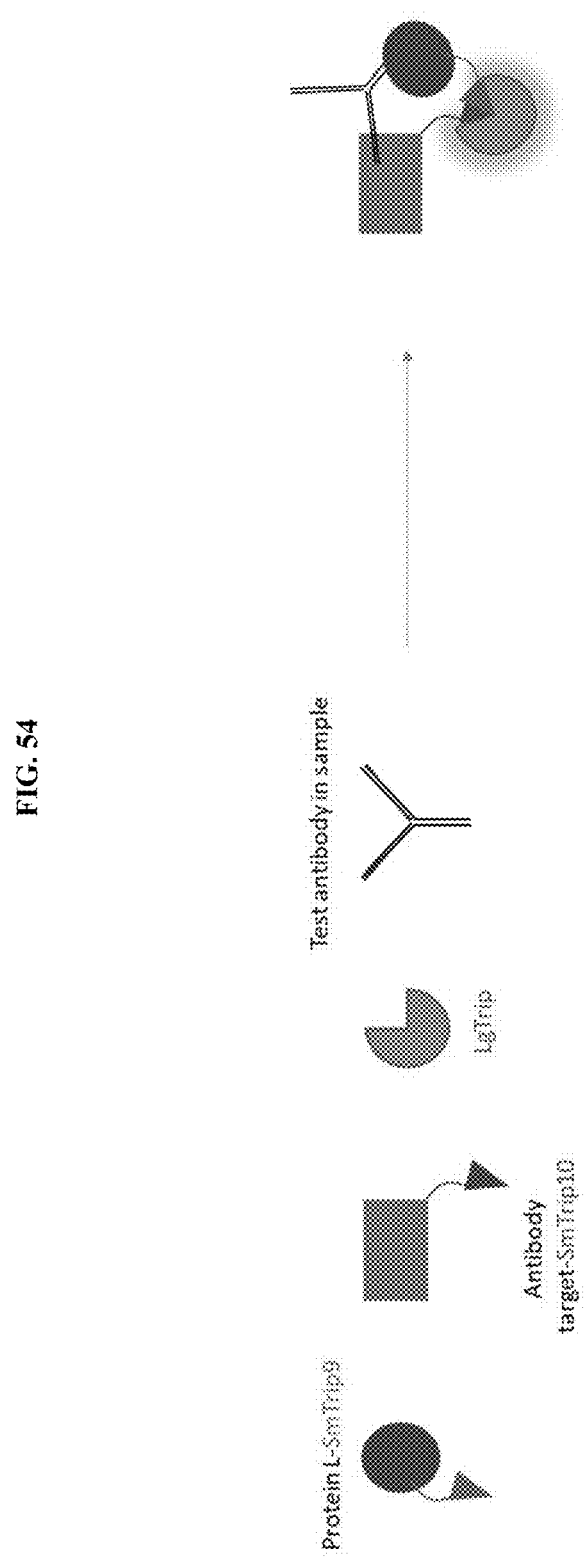
FIG. 54. Schematic illustration of an exemplary antibody detection assay.

An exemplary multiplexed tripartite lateral flow assay for the detection and identification of anti-viral antibodies, e.g., for disease diagnosis, using tripartite antibody fusions in a direct immunoassay is depicted in FIG. 53. In this example, a sample is added to the lateral flow device and allowed to flow into a conjugation zone (e.g., pad). The conjugation zone comprises a generic antibody-binding agent (e.g., Protein L), tethered or fused to a first peptide tag (e.g., β10-like (e.g., SmTrip10) peptide). If antibodies are present in the sample, they will be bound by the labeled antibody-binding agent. A detection window of the device comprises separate lanes, each comprising distinct immobilized viral antigens tethered or fused to a second peptide tag (e.g., β9-like (e.g., SmTrip9) peptide). As the labeled antibody flows from the conjugation zone into the detection window, the antibodies will bind to appropriate antigens, binging the peptide tags into proximity and producing a luminescent signal in the presence of the polypeptide component and substrate (e.g., preloaded in the detection window, added with the sample, added separately to the device, etc.). Such a device and assay would allow detection and discrimination of multiple viruses and viral infections using a single device/assay. For example, Zika, Dengue, and Chicungkunga could all be independently detected using a single test.

In some embodiments, the details of the above lateral flow assays are carried out in a plate-based format for solution phase assay (e.g., with the binding moiety combinations in wells provided with a map). In some embodiments, such an assay is performed in a multiplexed dot blot/spot array assay format. In some embodiments, any multiplexed assays described herein in a particular format (e.g., lateral flow) may also be performed in alternative formats described herein or understood in the field (e.g., dot blot, spot array, etc.).

In some embodiments, the peptide/dipeptide/tripeptide tags (e.g., β6-like, β7-like, β8-like, β9-like (e.g., SmTrip9), and/or β10-like (e.g., SmTrip10) peptides, and/or dipeptides and tripeptides thereof) and polypeptide components (e.g., β1-5-like, β1-6-like, β1-7-like, β1-8-like (e.g., LgTrip) polypeptide) herein find use in aerosol-based detection (e.g., (1) protease to lyse cells, (2) spray detection reagents, (3) visualize to detect/quantify).

Figure 55:
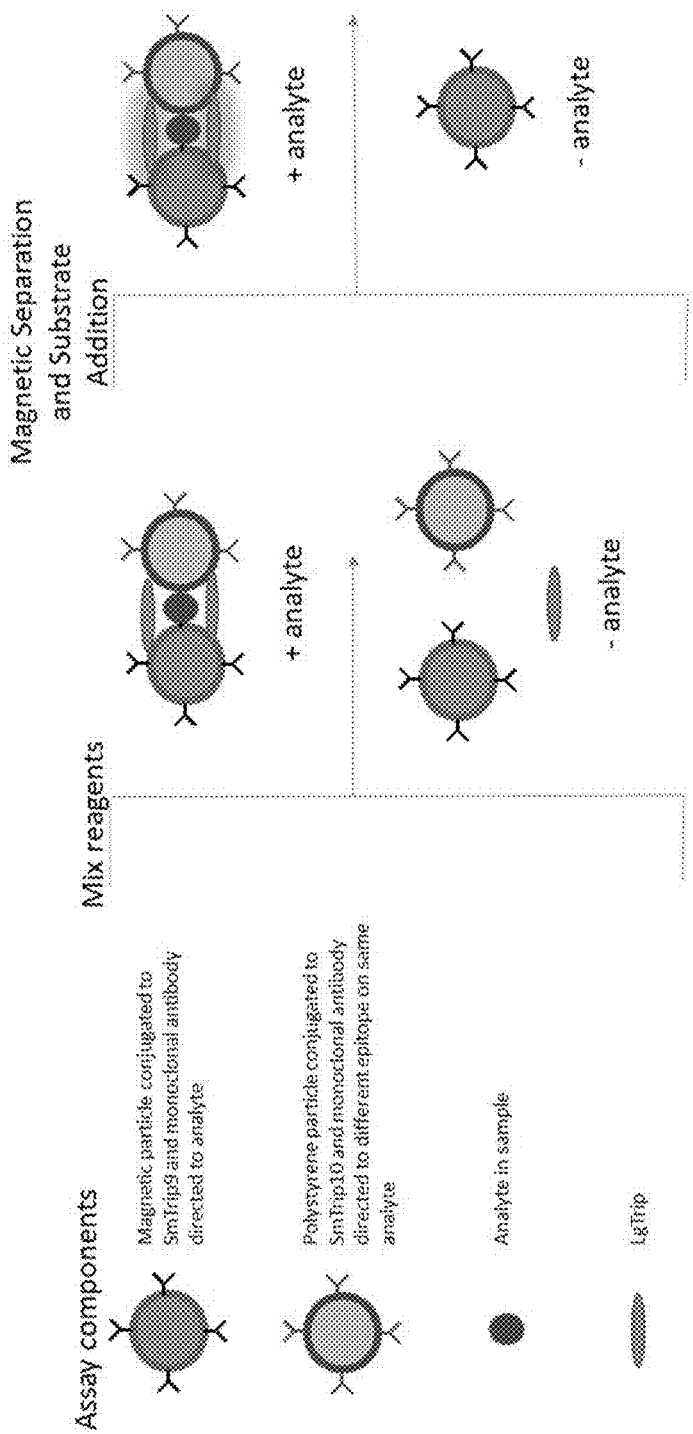
FIG. 55. Schematic illustration of an exemplary bead-based assay.
Figure 56:
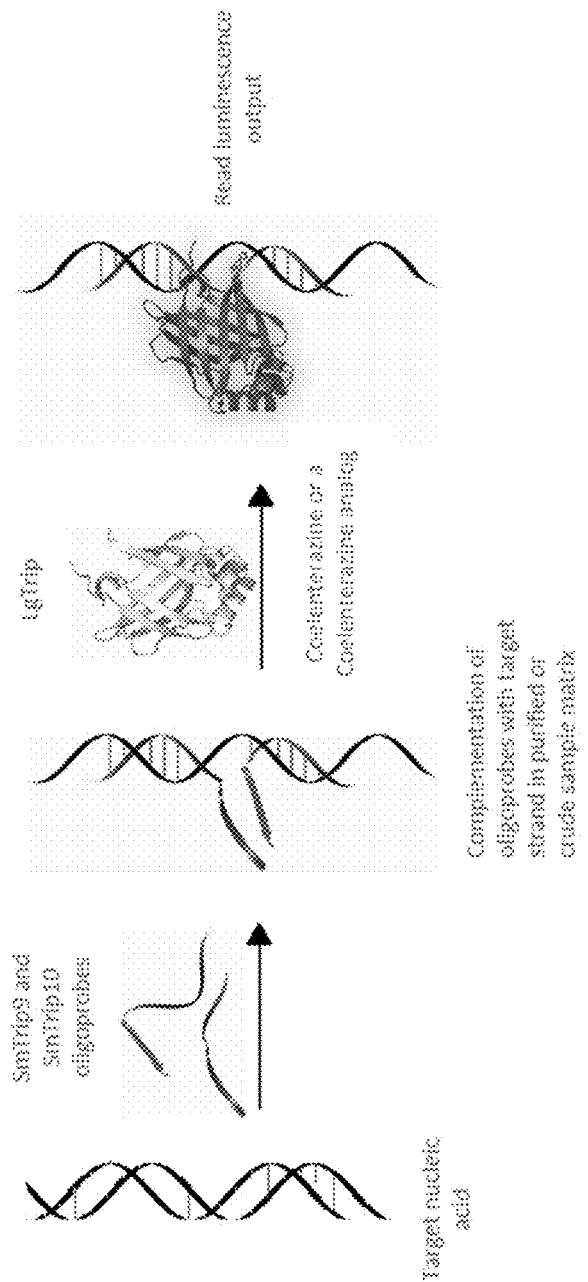
FIG. 56. Schematic illustration of an exemplary nucleic acid detection assay.

In some embodiments, the peptide/dipeptide/tripeptide tags (e.g., β6-like, β7-like, β8-like, β9-like (e.g., SmTrip9), and/or β10-like (e.g., SmTrip10) peptides, and/or dipeptides and tripeptides thereof) and polypeptide components (e.g., β1-5-like, R1-6-like, β1-7-like, β1-8-like (e.g., LgTrip) polypeptide) herein find use with isothermal amplification of nucleic acids.

In some embodiments, the peptide/dipeptide/tripeptide tags (e.g., β6-like, β7-like, β8-like, β9-like (e.g., SmTrip9), and/or β10-like (e.g., SmTrip10) peptides, and/or dipeptides and tripeptides thereof) and polypeptide components (e.g., β1-5-like, R1-6-like, β1-7-like, β1-8-like (e.g., LgTrip) polypeptide) herein find use with rapid cycling PCR detection of nucleic acids.

In some embodiments, the peptide/dipeptide/tripeptide tags (e.g., β6-like, β7-like, β8-like, β9-like (e.g., SmTrip9), and/or β10-like (e.g., SmTrip10) peptides, and/or dipeptides and tripeptides thereof) and polypeptide components (e.g., β1-5-like, β1-6-like, β1-7-like, β1-8-like (e.g., LgTrip) polypeptide) herein find use in the detection of protein-protein interaction (e.g., between 2 proteins, between 3 proteins, etc.).

In some embodiments, analysis of the assays and methods described herein is performed using stationary or portable devices and readers, a luminometer plate reader or handheld reader, smart phone camera or CCD camera, etc.

In some embodiments, analyte is detected/quantified via gain of signal through recognition elements via luminometer or imaging based techniques.

In some embodiments, analyte is detected/quantified measured via loss of signal through competitive displacement via luminometer or imaging based techniques.

In some embodiments, systems and methods herein allow for multiple tags on each recognition element, either genetically or through chemical conjugation, thereby providing signal amplification by adding increasing stoichiometry of peptide tags per recognition element.

In some embodiments, systems and methods herein find use in detection of native proteins in heterogeneous solutions.

In some embodiments, the peptide/dipeptide/tripeptide tags (e.g., β6-like, β7-like, β8-like, β9-like (e.g., SmTrip9), and/or β10-like (e.g., SmTrip10) peptides, and/or dipeptides and tripeptides thereof) and polypeptide components (e.g., β1-5-like, β1-6-like, β1-7-like, β1-8-like (e.g., LgTrip) polypeptide) herein find use in nucleic acid detection, for example, peptide-tagged complimentary recognition elements hybridize to a nucleic acid target sequence in tandem.

In some embodiments, assays are provided herein for the detection of an antibody (e.g., antibody as analyte). One such assay is depicted in FIG. 54. A first peptide tag (e.g., β9-like (e.g., SmTrip9) peptide) is fused or tethered to an antibody-binding protein (e.g., Protein L) and a second peptide tag (e.g., β10-like (e.g., SmTrip10) peptide) is fused or tethered to the analyte that the antibody is specific to; a polypeptide component (e.g., β1-8-like (e.g., LgTrip) polypeptide) of the luminescent complex is included as part of detection reagent (e.g., with substrate); presence of the analyte specific antibody in a sample results in complex formation and luminescence.

In some embodiments, the peptide/dipeptide/tripeptide tags (e.g., β6-like, β7-like, β8-like, β9-like (e.g., SmTrip9), and/or β10-like (e.g., SmTrip10) peptides, and/or dipeptides and tripeptides thereof) and polypeptide components (e.g., β1-5-like, R1-6-like, β1-7-like, β1-8-like (e.g., LgTrip) polypeptide) herein find use in FISH-like applications utilizing bioluminescence or BRET for detection/quantification.

In some embodiments, the peptide/dipeptide/tripeptide tags (e.g., β6-like, β7-like, β8-like, β9-like (e.g., SmTrip9), and/or β10-like (e.g., SmTrip10) peptides, and/or dipeptides and tripeptides thereof) and polypeptide components (e.g., β1-5-like, β1-6-like, β1-7-like, β1-8-like (e.g., LgTrip) polypeptide) herein find use in detection of nucleic acids (e.g., single stranded and/or double stranded DNA and/or RNA) via, for example amplification-free detection of nucleic acids. For example, as depicted in FIG. 56, a pair of peptide tag-labelled nucleic acid probes, when hybridized to nearby locations on a nucleic acid target, will allow formation of a luminescent complex, facilitated by complementation with the nucleic acid target. Such and assay could be performed on a solid surface, in solution, for a single nucleic acid target, or multiplexed (e.g., using an array).

In some embodiments, peptide/dipeptide/tripeptide tags (e.g., β6-like, β7-like, β8-like, β9-like (e.g., SmTrip9), and/or 10-like (e.g., SmTrip10) peptides, and/or dipeptides and tripeptides thereof) and polypeptide components (e.g., β1-5-like, β1-6-like, β1-7-like, β1-8-like (e.g., LgTrip) polypeptide) herein find use in lab-on-chip and/or microfluidics applications.

In some embodiments, systems and methods herein find use in heterogeneous assays, such as, immunoassays (e.g., PCR amplification combined with homogeneous immunoassay analysis).

In some embodiments, a peptide/dipeptide/tripeptide-based sensor is provided is which a chemical (e.g., removal of a blocking moiety) or enzymatic (e.g., proteolytic cleavage) event is required to render a peptide tag capable of bioluminescent complex formation. For example, a protease is required to cleave a blocked dipeptide (e.g., incapable of bioluminescent complex formation) into two non-blocked peptides capable of complementation. In some embodiments, the peptide/dipeptide/tripeptide tags (e.g., $\beta_6$-like, $\beta7$-like, $\beta8$-like, $\beta9$-like (e.g., SmTrip9), and/or $\beta10$-like (e.g., SmTrip10) peptides, and/or dipeptides and tripeptides thereof) and polypeptide components (e.g., $\beta_{1-5}$-like, $\beta_{1-6}$-like, 1-7-like, $\beta1$-8-like (e.g., LgTrip) polypeptide) herein find use with bead-based assays, utilizing magnetic enrichment for increased assay sensitivity. One such assay is depicted in FIG. 55. In such an assay, a magnetic particle is conjugated to a first peptide tag (e.g., $\beta9$-like (e.g., SmTrip9) peptide) and to a first binding agent directed to a first epitope on an analyte; a non-magnetic particle (e.g., polystyrene particle) is conjugated to a second peptide tag (e.g., $\beta10$-like (e.g., SmTrip10) peptide) and to a second binding agent directed to the first epitope or a second epitope on an analyte. The beads are combined with a sample, along with a polypeptide component (e.g., 11-8-like (e.g., LgTrip) polypeptide) of the luminescent complex. Magnetic separation is used to capture the magnetic beads and any components of the sample or other reagents bound thereto. Luminescence of the magnetically-captured elements is then detected in the presence of substrate for the luminescent complex. If the analyte is present in the sample, both the magnetic and non-magnetic beads will be captured, resulting in the capture of the luminescent complex. In the absence of analyte, the non-magnetic beads will not be captured, and the luminescent complex will not be formed. The above applications and formats are exemplary and non-limiting. Other embodiments consistent with the description herein are within the scope of the present invention. Systems comprising and method utilizing peptides, dipeptides, and polypeptides bearing structural (although not necessarily sequence identity) and functional correlation to portions of NanoLuc® commercial luciferase and/or natural luciferase from Oplophorus gracilirostris, and bioluminescent complexes formed by complementation thereof, are described herein. In particular, detailed description is provided of complementaion between $\beta_{1-8}$-like (e.g., LgTrip) polypeptides and either $\beta9$-like (e.g., SmTrip9) and $\beta_{10}$-like (e.g., SmTrip10) peptides or $\beta_{9-10}$-like dipeptides. However, embodiments herein are not limited to complementation between $\beta_{1-8}$-like polypeptides (e.g., LgTrip) and 9-like (e.g., SmTrip9) and $\beta_{10}$-like (e.g., SmTrip10) peptides or $\beta_{9/10}$-like dipeptides. In some embodiments, peptides, dipeptides, and polypeptides bearing structural (although not necessarily sequence identity) and functional correlation to portions of NanoLuc® commercial luciferase and/or natural luciferase from Oplophorus gracilirostris are provided. For example, also provided herein are systems and methods for complementation between a $\beta_{1-5}$-like polypeptide and 36-10-like polypeptide; between a $\beta_{1-2}$-like dipeptide and $\beta_{13-10}$-like polypeptide; between a $\beta_1$-like peptide, $\beta_2$-like peptide and $\beta_{3-10}$-like polypeptide; between a $\beta_{7-8}$-like dipeptide and $\beta_{9-10/1-6}$-like polypeptide fusion; between a $\beta_{1-7}$-like polypeptide and $\beta_8$-like, $\beta9$-like, and $\beta_{10}$-like peptides; and/or between a $\beta_{1-6}$-like polypeptide and $\beta_7$-like, $\beta_8$-like, $\beta_9$-like, and $\beta_{10}$-like peptides.

In some embodiments, the peptides, dipeptides, triprptides, and/or polypeptides herein find use in translocation assays. In some embodiments, a translocation assay is composed of two components: a complementary polypeptide sensor (e.g., LgBiT-based, LgTrip-based, etc.) and a peptide/dipeptide/tripeptide-tagged protein of interest (POI). A variety of LgBiT sensors were generated that localize at specific cellular compartments such as plasma membrane, nucleus, mitochondria and endoplasmic reticulum (ER) (FIG. 152). These LgBiT sensors can be introduced to cells via transfection or establishment of stable cell lines. The POI is endogenously tagged with peptide/dipeptide/tripeptide complementary to the polypeptide (e.g., LgBiT). Under stimuli, the POI translocates to a different cellular compartment where the polypeptide (e.g., LgBiT) sensor resides, complementation occurs leading to the assembly of peptide/polypeptide complex (e.g., HiBiT·LgBiT) to yield luminescence signal (FIG. 153). Thus, the translocation activity of POI is quantitatively measured via luminescence output. Experiments conducted during development of embodiments of the translocation assay are described in Example 89.

As described further herein, translocation assays can be designed as part of a modular system that includes, for example, the following components: 1) Cell lines expressing HiBiT-tagged proteins from endogenous loci; and 2) a LgBiT localization sensor. This principal design allows for the correlation of a luminescent signal with the presence of the target protein at a specific cellular localization. The sensors can include localization-specific sequences fused to a LgBiT affinity variant, as well as to HaloTag® for validation and imaging of the target compartment. Localization-specific sequences can be short peptides that are derived from known protein cellular markers. In some embodiments, when short peptides are not specific enough to exclude the LgBiT sensor to the cellular compartment of choice, full length protein marker can be used to fuse to the sensor. DNA sequences encoding LgBiT localization sensors can be cloned into a circular double-stranded DNA plasmid, which can be delivered into HiBiT cell line. In some embodiments, the delivery method can be via lipid based transfection using Fugene HD transfection reagent, or via viral transduction using Lenti viral particles or BacMam. In some embodiments, when transfected/transduced, cells are treated by an agonist, and HiBiT-tagged protein translocates to the cellular compartment where LgBiT sensor resides; complementation occurs and produces luminescence. In some embodiment, the agonists are small molecules that stimulate translocation of the target protein.

EXPERIMENTAL

Example 1

Further Truncated Version of (LgBiT) is Activated by Peptide

Figure 1:
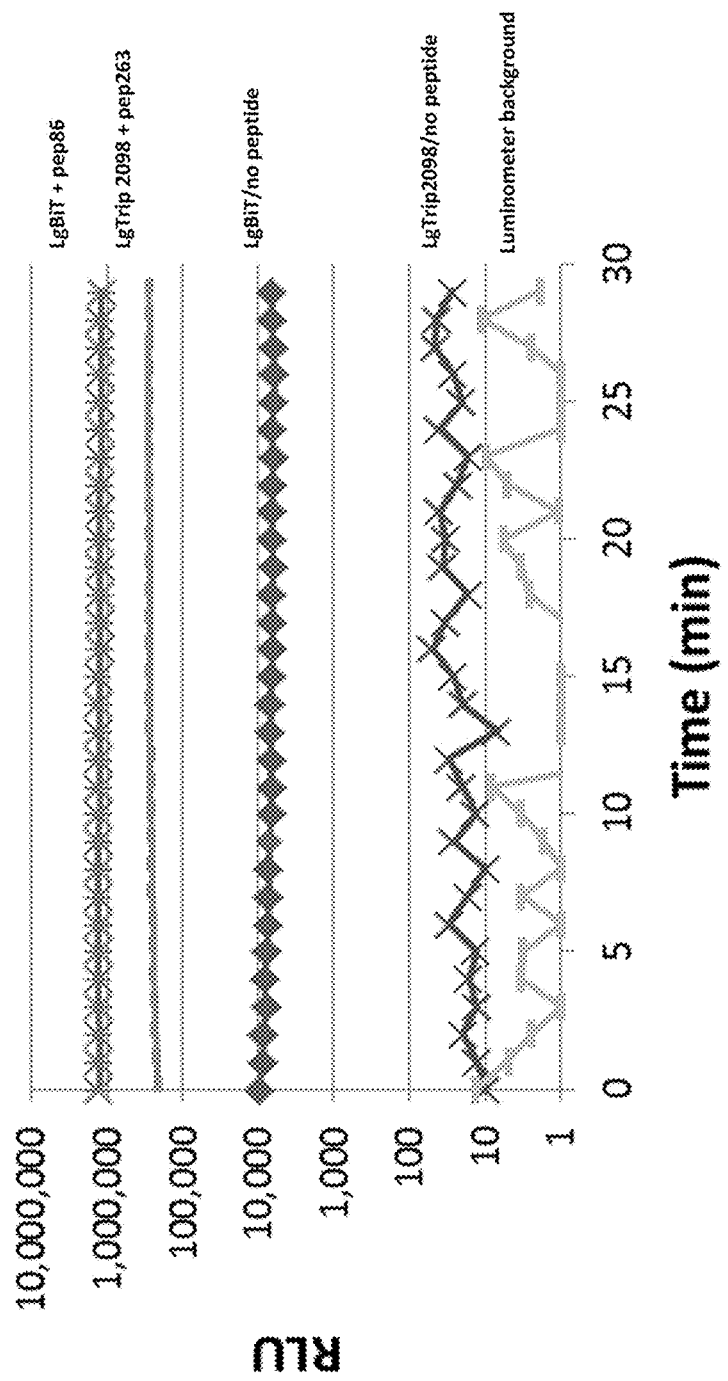
FIG. 1. Graph demonstrating that a polypeptide lacking β9 and β10 portions (LgTrip 2098; SEQ ID NO: 17) exhibits reduced background luminescence compared to LgBiT (SEQ ID NO: 11) and is activated by complementation with a peptide corresponding to β9 and β10.

The luminescence of LgBiT (background and in the presence of complementary SmTrip10 pep86)(SEQ ID NO: 15, 25) was compared with a further truncated polypeptide (LgTrip 2098, SEQ ID NO: 17) lacking both the $\beta10$ and $\beta9$ strands of the full-length luciferase (background and in the presence of complementary pep263 (SEQ. ID 35)) (FIG. 1).

E. coli KRX harboring LgBiT (SEQ ID NO: 11) or LgTrip 2098 (SEQ ID NO: 17) were grown for 20 h from a single colony in LB+amp (50 ug/mL) at 30° C. (275 rpm) in a volume of 50 mL. From these cultures, 100× dilutions were made into the same media and the cultures grown at 37C (275 rpm) for 3 h and then cooled to 25° C. before adding rhamnose (inducing agent for protein overexpression) to a final concentration of 0.2%. Cultures were then grown (induced) for 22 h at 25° C. (275 rpm) at which time cultures were harvested, and the resulting pellets stored at −20° C. until processing. To lyse cells, pellets were removed from −20° C., resuspended in 50 mL of PBS pH 7.2, and taken through 3 sequential freeze thaw cycles (−70° C. to 22° C.), centrifuged to produce soluble fractions, and then kept cold (on ice) until assaying. Lysates and peptide(s) (25 nm final concentration) were incubated together for 10 minutes at 25° C. prior to the addition of NanoGlo® reagent. After addition of reagent, plates were incubated for another 5 min at 35° C. and read over time to measure luminescence (RLU) using a Tecan Infinite F500 plate reader.

Experiments conducted during development of embodiments herein demonstrate that both LgBiT (SEQ ID NO: 11) and LgTrip 2098 (SEQ ID NO: 17) produce some background luminescence, but the level is much higher for LgBiT. Data shows that both LgBiT and LgTrip 2098 produce more luminescence in the presence of their respective complementary peptide. The magnitude of the gain in signal in the presence of peptide is greater for LgTrip 2098. These data demonstrate that the further truncated LgBiT (and with the A51G substitution) is activated by a single complementary peptide corresponding to the β10 and β9 beta strands that are absent from LgTrip 2098.

Example 2

LgTrip 2098 is Activated by Pair of Separate β9 and β10-Like Peptides

Figure 2:
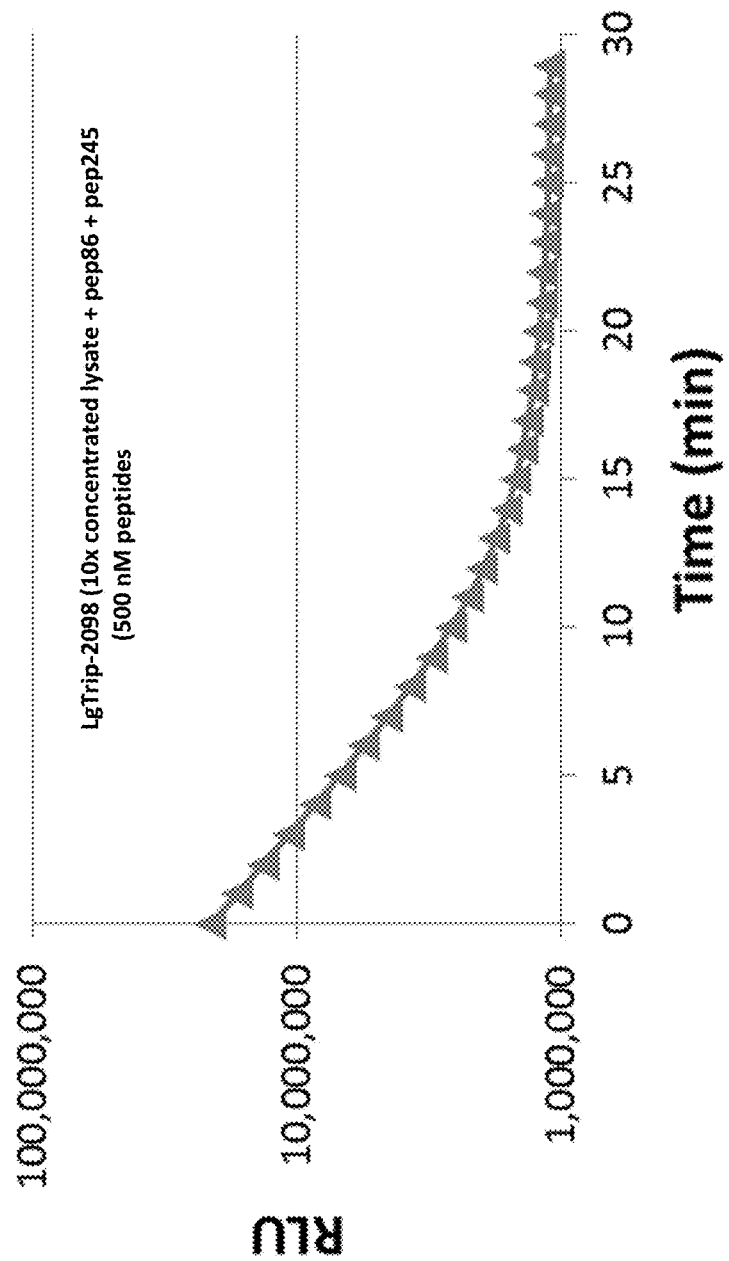
FIG. 2. Graph demonstrating activation of LgTrip 2098 (SEQ ID NO: 17) by separate peptide corresponding to β9 and β10, respectively.

The luminescence of LgTrip 2098 (SEQ ID NO: 31) was monitored over time in the presence of separate peptides corresponding to the β10 and β9 portions of the full-length luciferase (SmTrip10 pep86 (SEQ ID NO: 25) and SmTrip9 pep245) (SEQ ID NO: 23) (FIG. 2). Similar experimental protocols were used as in Example 1; however, a 10× concentrated lysate was used, Peptides SmTrip10 pep86 and SmTrip9 pep245 were used at 500 nM, and 0.001% Prionex added to reactions. Experiments conducted during development of embodiments herein demonstrate that LgTrip 2098 (SEQ ID NO: 31) is activated by the addition of SmTrip10 pep86 and SmTrip9 pep245. Controls with no peptides added or only one of the peptides added produced near the background of the plate reader.

Example 3

LgTrip Mutagenesis —Round 1 (Luminescence)

Overnight cultures used for sequencing were used to inoculate cultures (30 ul of cells in 3 ml of media+0.1% Rhamnose+0.15% glucose). Cells were grown overnight at 25° C. for 20 hours. Cells were diluted 10 ul into 250 ul of Passive Lysis Buffer (PLB) and allowed to lyse for 5 minutes. The lysate was mixed and then diluted 1:100 into PLB lysis buffer (0.3× PLB, 25 mM HEPES pH 7.5, 0.001U/ml RQ DNase 1 (10 ul in 990 ul). 50 ul of the diluted lysate was combined with 50 ul of NanoGlo® buffer+2 uM pep263 (SmTrip9-10 dipeptide) (SEQ ID NO: 35) at a 1 uM final concentration (saturating dipeptide concentration). Samples were incubated for 5 minutes, read on GloMax® Multi+(GMM+) luminometer, and normalized to LgTrip 2098 (SEQ ID NO: 31) (Table 2).

TABLE 2

Relative luminescence of LgTrip variants compared to LgTrip 2098.

| Clone # | Cell plate | Sequence | Secondary screen(normalize to 2098) |
|---|---|---|---|
| #7 | | F1L | 1.1 |
| #10 | | Q42L | 1.8 |

TABLE 2-continued

Relative luminescence of LgTrip variants compared to LgTrip 2098.

| Clone # | Cell plate | Sequence | Secondary screen(normalize to 2098) |
|---|---|---|---|
| #14 | | I44V, E63D, L142Q | 2.5 |
| #16 | | L30S | 8.3 |
| #19 | | N17D | 3.0 |
| #22 | | Y16C, I56T | 2.6 |
| #35 | | L142Q | 1.8 |
| #38 | | T2S, M106K | 1.8 |
| #39 | | E4D, V27A | 3.7 |
| #42 | | E4D | 2.5 |

Example 4

LgTrip Mutagenesis—Round 1 (Stability)

Figure 3:
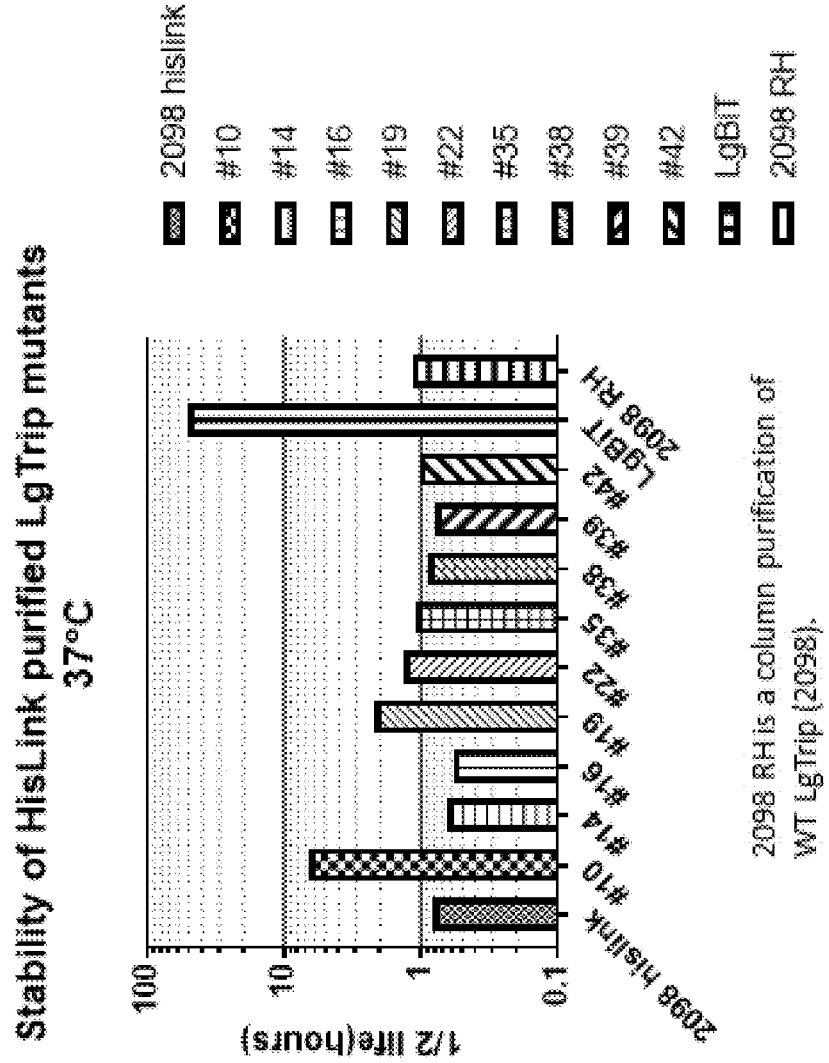
FIG. 3. Graph depicting the relative stability of exemplary LgTrip 2098 mutants.

Experiments were conducted during development of embodiments herein to determine the stability of HisLink purified LgTrip mutants. LgTrip 2098 (SEQ ID NO: 31), LgTrip 2098 (RH) (SEQ ID NO: 31) (column purified LgTrip 2098), #10, #14, #16, #19, #22, #35, #38, #39, and #42 polypeptides (Table 3) were diluted 1:1000 into PLB lysis buffer (2 ul into 2 ml). 100 ul of each sample was transferred into one column of wells in a 96-well PCR tray. Samples were incubated at 37° C., and aliquots were remove at various time-points. Samples were placed on ice when thermal treatment was complete. When all samples were processed, the PCR tray was equilibrated to room temperature. Samples were mixed and then diluted 1:100 in PLB lysis buffer (5 ul into 495 ul buffer). 50 ul of each sample was combined with 50 ul of NanoGlo® buffer reagent+2 uM pep263. The plate was incubated for 5 minutes and then read on GMM+. Results are depicted in FIG. 3. Stability studies identified position 42 of LgTrip 2098 (SEQ ID NO: 31) as a position of interest for further analysis.

TABLE 3

Experimental nomenclature for LgTrip mutants (mutations relative to LgTrip 2098).

| Clone # | Sequence |
|---|---|
| #10 | Q42L |
| #14 | I44V, E63D, L142Q |
| #16 | L30S |
| #19 | N17D |
| #22 | Y16C, I56T |
| #35 | L142Q |
| #38 | T2S, M106K |
| #39 | E4D, V274 |
| #42 | E4D |

Example 5

Position 42 Site Saturation (Luminescence)

Figure 4:
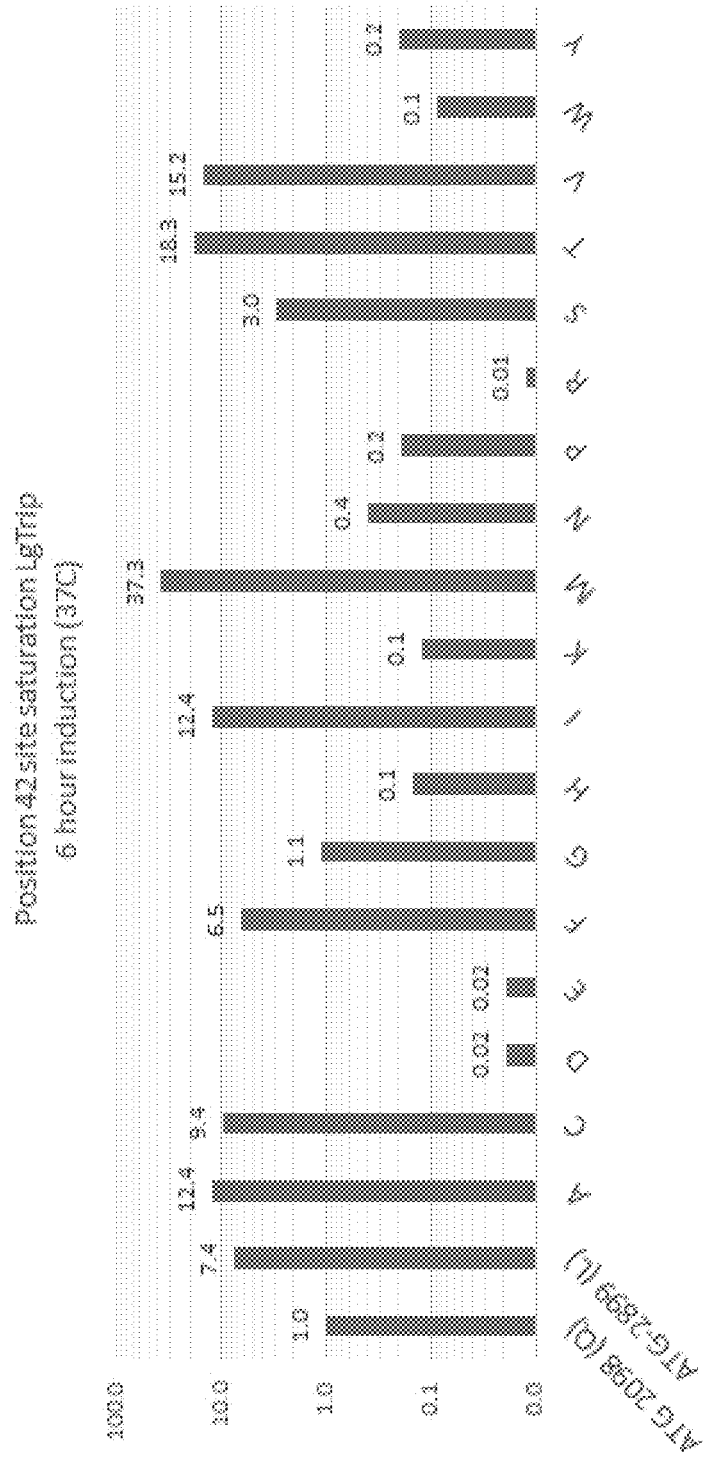
FIG. 4. Graph depicting the relative luminescent activity of amino acid site saturation at position 42 of LgTrip 2098 mutants.

Experiments were conducted during development of embodiments herein to optimize the identity of the amino acid at position 42 of LgTrip 2098 (SEQ ID NO: 31) (FIG. 4). E. Coli cultures (3 ml) were prepared for each sample and grown overnight at 37° C. in LB media+100 ug/ml ampicillin. Cultures were then diluted in quadruplicate at a 20× concentration (10 μl in 200 μl) into induction media (LB+ampicllin+0.1% Rhamnose).

Samples were grown at 37° C. for 6 hours. Samples were then lysed with 0.3× PLB, 25 mM HEPES pH 7.5, and 0.001U/ml RQ1 DNase (10 µl of cells to 250p of Lysis buffer). 50 µl of the lysate was then combined with 50 µl of NanoGlo® buffer+50 µM furimazine+20 nM of dipeptide 263 (SEQ ID NO: 35). Samples were measured on a BMG Clariostar luminometer. RLU values were normalized to LgTrip 2098 (SEQ ID NO: 31).) (FIG. 4)

Example 6

37° C. Stability of Purified LgTrip Position 42 Mutants

Figure 5:
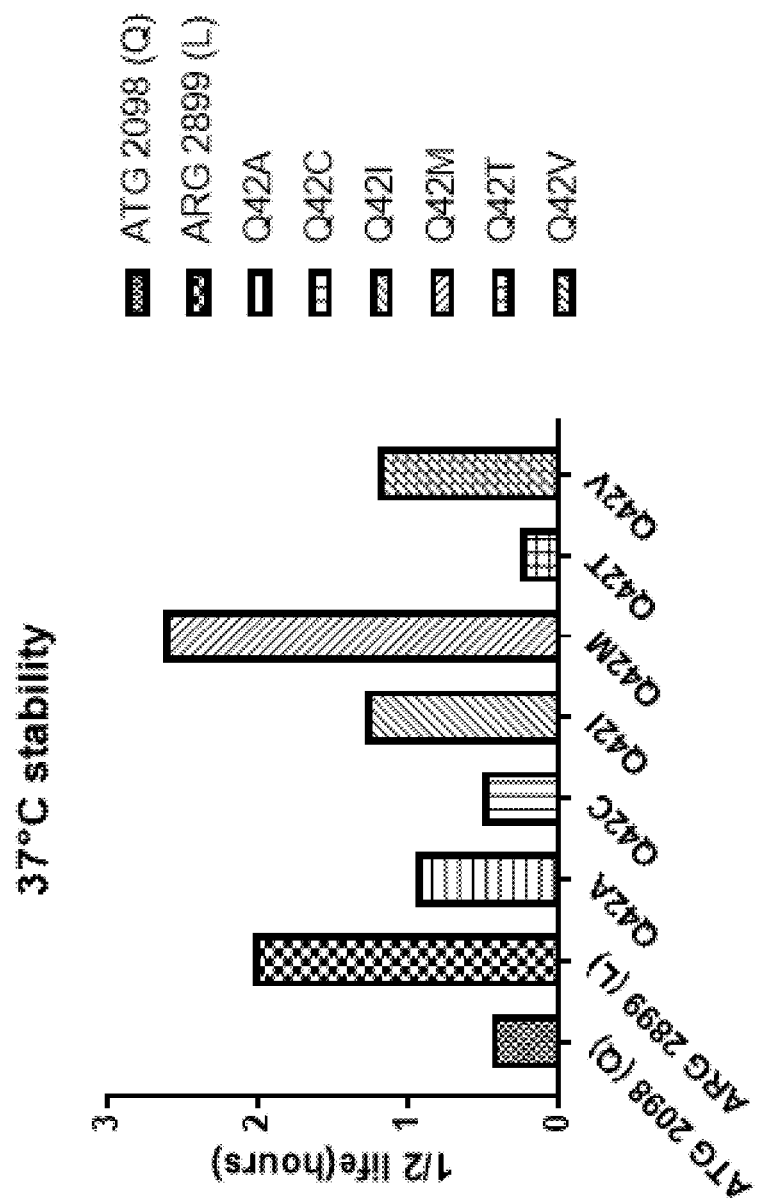
FIG. 5. Graph depicting the relative stability of amino acid changes at position 42 of LgTrip 2098 mutants.

Experiments were conducted during development of embodiments herein to determine the stability of position 42 in LgTrip 2098 mutants (FIG. 5). Polypeptides were diluted to 20 nM in TBS+0.01% BSA. In triplicate, 100 µl aliquots of each sample were loaded into 200 µl thin walled PCR tubes. Samples were incubated at 37° C. in thermal cycler. Samples were removed at various time-points, placed on ice, and then allowed to equilibrate to room temperature. Samples were diluted to 0.2 nM (5 in 495 µl) in PLB lysis buffer (0.3× PLB+25 mM HEPES pH 7.5). 50 µl of each diluted sample was combined with 50 µl of 50 µM Furimazine+6 µM pep263 (SEQ ID NO: 35) in NanoGlo® buffer. Samples were incubated for 10 minutes and then read on GMM+. Half-life was calculated by non-linear regression (FIG. 5).

Example 7

Site Saturation of LgTrip

Figure 6A:
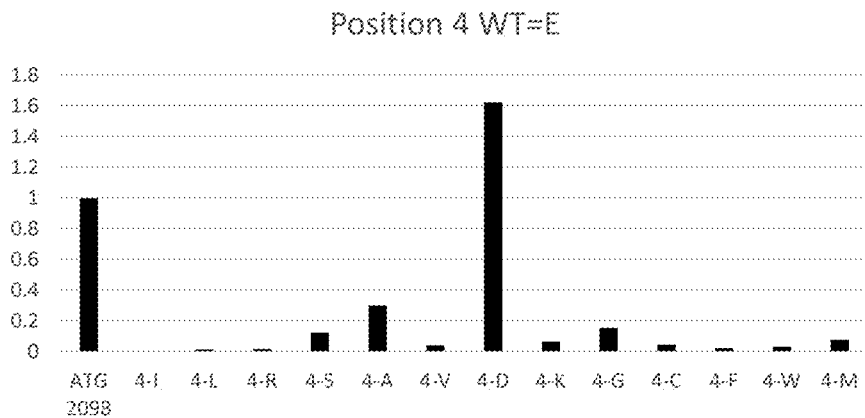
FIGS. 6A-C. Graph depicting the relative luminescent activity of amino acid changes at (A) position 4, (B) position 30, and (C) position 106 of LgTrip 2098 mutants.
Figure 6B:
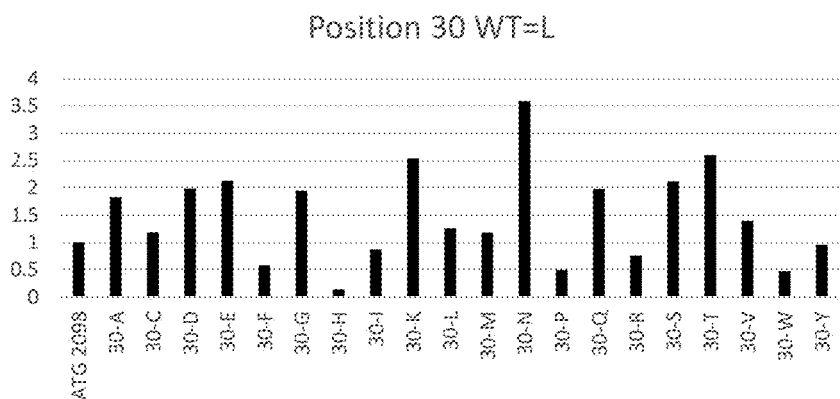
Figure 6C:
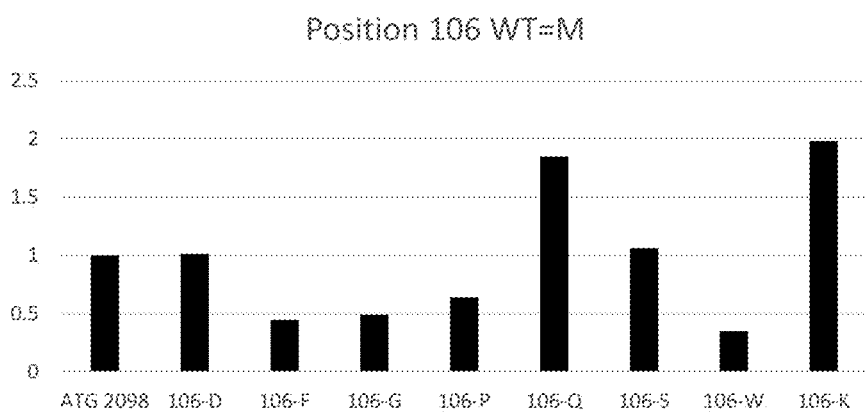
Figure 7A:
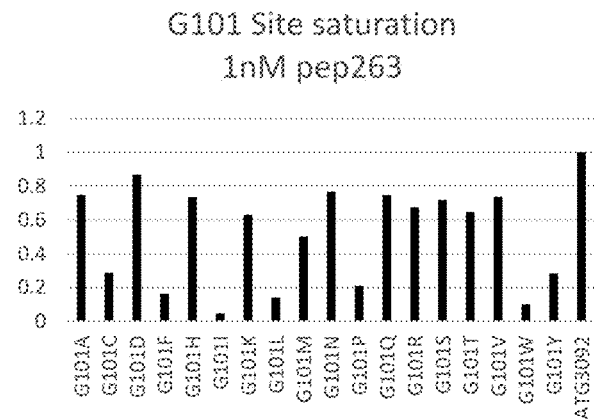
FIGS. 7A-E. Graph depicting the relative luminescent activity of amino acid changes at (A) position 101, (B) position 117, (C) position 127, (D) position 120, and (E) position 126 of LgTrip 3092 mutants.
Figure 7B:
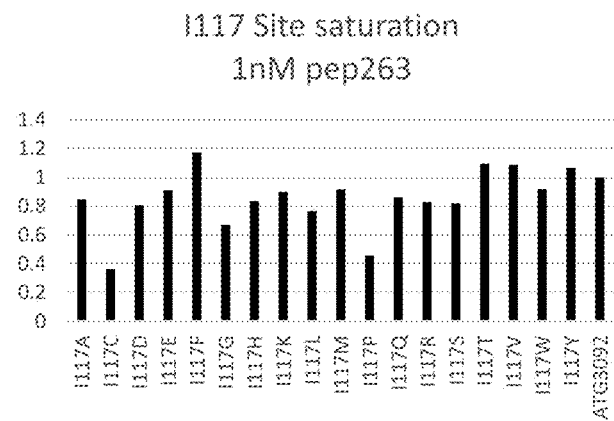
Figure 7C:
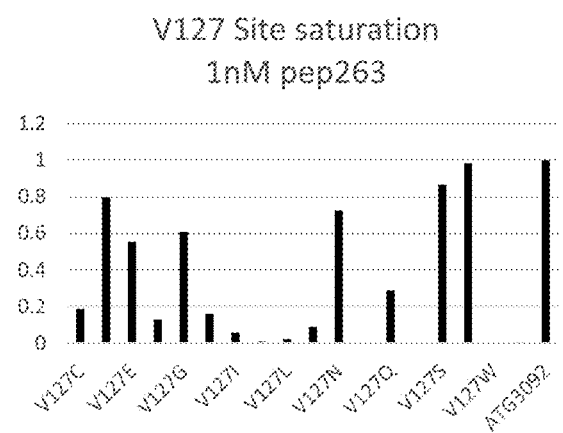
Figure 7D:
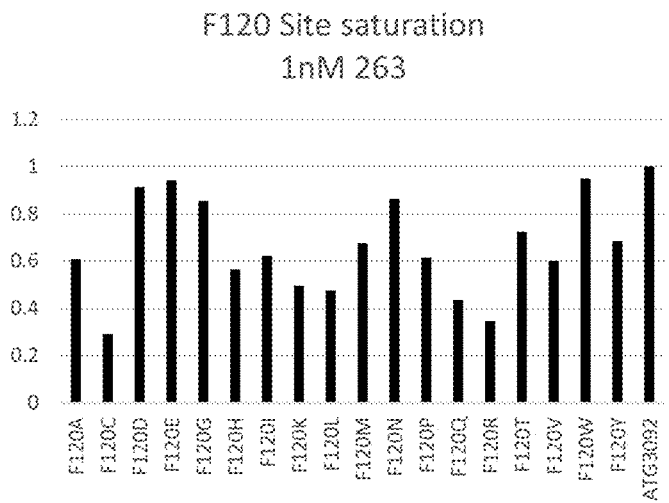
Figure 7E:
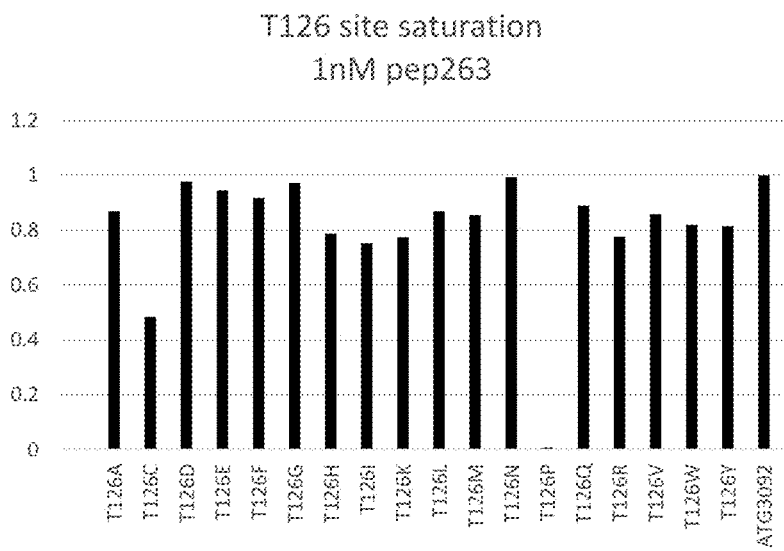

Experiments were conducted during development of embodiments herein to optimize the identity of the amino acid at various positions of LgTrip 2098 (SEQ ID NO: 31) (FIG. 6). E. coli cultures (3 ml) were prepared for each sample and grown overnight at 37° C. in LB media+100 pg/ml ampicillin. Cultures were then diluted in quadruplicate to a 20× concentration (10 µl in 200 µl) into induction media (LB+ampicllin+0.1% Rhamnose).

Samples were grown at 37° C. for 6 hours. Samples were then lysed with 0.3× PLB+25 mM HEPES pH 7.5+0.001U/ml DNase (10 µl of cells to 250 µl of Lysis buffer). 50 µl of the lysate was then combined with 50 µl of NanoGlo® buffer+50 µM furimazine+20 nM of dipeptide 263 (SEQ ID NO: 35). Samples were measured on a BMG Clariostar luminometer. RLU values were normalized to LgTrip 2098 (SEQ ID NO: 31)(FIG. 6).

Example 8

Mutations on LgTrip 3092 Template

Experiments were conducted during development of embodiments herein to determine the effect of various amino acid substitutions relative to the LgTrip 3092 (SEQ ID NO: 19) variant (Table 4). E. co/i cultures (3 ml) were prepared for each sample and grown overnight at 37° C. in LB media+100 ug/ml ampicillin. Cultures were then diluted in quadruplicate to a 20× concentration (10 µl in 200 µl) into induction media (LB+ampicllin+0.1% Rhamnose). Samples were grown at 37° C. for 6 hours. Samples were then lysed with 0.3× PLB+25 mM HEPES pH 7.5+0.001U/ml DNase. (10 µl of cells to 250 µl of Lysis buffer). 50 µl of the lysate was then combined with 50 µl of NanoGlo® buffer+50 µM furimazine+2 nM of dipeptide 263 (SEQ ID NO: 35). The mutant lysates were further diluted 1:100 in PLB (5 µl in 495 µl). 50 µl of the diluted lysate was added to 50 µl of NanoGlo® buffer+50 µM furimazine+6 µM pep263 or 50 µl of TBS+20 µM LCS (furimazine)+6 µM pep263 (SEQ ID NO: 35). Samples were measured on a GMM+after a 10 minute incubation.

TABLE 4

Relative luminescence of LgTrip variants compared to LgTrip 3092.

| Sample | LCS 6uM 263 | Nglo 6uM 263 | Nglo 2nM 263 |
|---|---|---|---|
| ATG 3092 | 1.0 | 1.0 | 1.0 |
| V127A | 4.2 | 3.5 | 3.7 |
| Y16S | 1.3 | 1.3 | 3.1 |
| V119A | 1.4 | 1.2 | 2.0 |
| V127A + T128A | 4.9 | 3.7 | 3.7 |
| I117N | 2.9 | 2.1 | 2.5 |
| F120S | 2.0 | 1.6 | 2.1 |
| G122D | 1.2 | 1.3 | 2.3 |
| N105S | 1.2 | 1.4 | 1.6 |
| T126S | 2.3 | 1.4 | 2.1 |
| G101E | 2.3 | 1.4 | 3.9 |
| V36E + V102D + E115D | 2.4 | 1.4 | 1.7 |

Example 9

Site Saturation of LgTrip 3092 Template

Experiments were conducted during development of embodiments herein to optimize the identity of the amino acid at various positions of LgTrip 3092 (SEQ ID NO: 19). E. coli cultures (3 ml) were prepared for each sample and grown overnight at 37° C. in LB media+100 ug/ml ampicillin. Cultures were then diluted in quadruplicate to a 20× concentration (10 µl in 200 i) into induction media (LB+ampicllin+0.1% o Rhamnose).

Samples were grown at 37° C. for 6 hours. Samples were then lysed with 0.3× PLB+25 mM HEPES pH 7.5+0.001U/ml DNase (10 d of cells to 250 µl of Lysis buffer). 50 µl of the lysate was then combined with 50 µl of NanoGlo® buffer+50 µM furimazine+2 nM of dipeptide 263 (1 nM final). Samples were measured on a BMG Clariostar luminometer. RLU values were normalized to LgTrip 3092 (FIG. 7).

Example 10

Stability of LgTrip 2098 and LgTrip 3092 Compared to LgBiT

Figure 8:
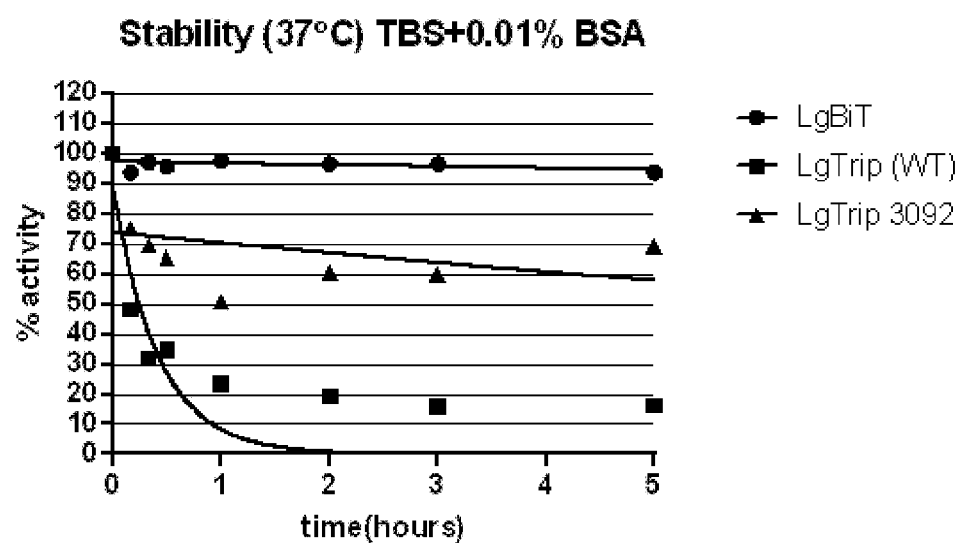
FIG. 8. Graph depicting the relative stability of LgTrip 2098 (WT)(SEQ ID NO: 31), LgTrip 3092 (SEQ ID NO: 19), and LgBiT (SEQ ID NO: 11) at 37° C.

Experiments were conducted during development of embodiments herein to compare the stability of positions in LgTrip 2098 (SEQ ID NO: 31) and LgTrip 3092 (SEQ ID NO: 33) to LgBiT (SEQ ID NO: 11) (FIG. 8). Purified LgTrip 2098, LgTrip 3092, and LgBiT samples were diluted to 20 nM in TBS+0.01% BSA. 100 µl of each sample was aliquoted into 200 µl thin walled PCR tubes. Samples were incubated at 37° C. in thermal cycler. Samples were removed at various time-points and placed on ice. Samples were equilibrated to RT and then diluted to 0.2 nM (5 µl in 495 µl) in PLB lysis buffer (0.3× PLB+25 mM HEPES pH 7.5). 50 µl of each sample was diluted with 50 µl of 50 µM Furimazine+6 µM pep263 (SEQ ID NO: 35) in NanoGlo® buffer. Samples were incubated for 10 minutes and then read on GMM+(FIG. 8).

Example 11

Stability of LgTrip Variants at 42° C. and 60° C.

Figure 9A:
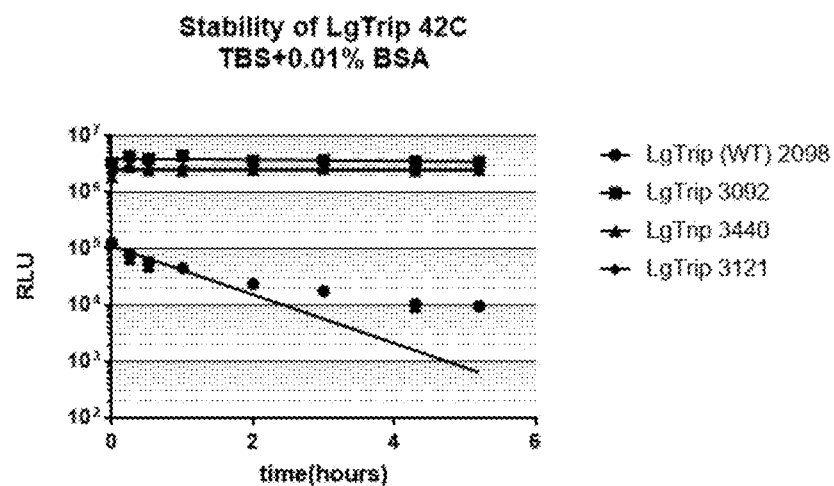
FIGS. 9A-B. Graph depicting the relative stability of LgTrip variants at (A) 42° C. and (B) 60° C.
Figure 9B:
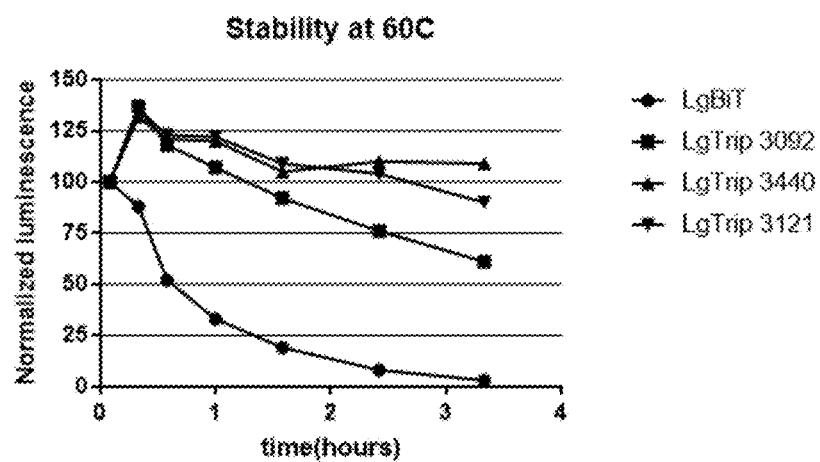

Experiments were conducted during development of embodiments herein to compare the stability of LgTrip variants at 42° C. and 60° C. (FIG. 9). The LgTrip variant samples were diluted to 20 nM in TBS+0.01% BSA. 100 µl aliquots were added into 200 µl thin walled PCR tubes. Samples were incubated at 42° C. or 60° C. in thermal cycler. Samples were removed at various time-points and placed on ice. Samples were equilibrated to RT and then each diluted to 0.2 nM (5 µl in 495β1) in PLB lysis buffer (0.3× PLB+25 mM HEPES pH 7.5). 50 µl of each diluted sample was combined with 50 µl of 50 uM Furimazine+6 µM pep263 (SEQ ID NO: 35) in NanoGlo® buffer. Samples were incubated for 10 minutes and then read on GMM+ (FIG. 9).

Example 12

Affinity of LgTrip Variants with SmTrip9 and SmTrip10

Figure 10A:
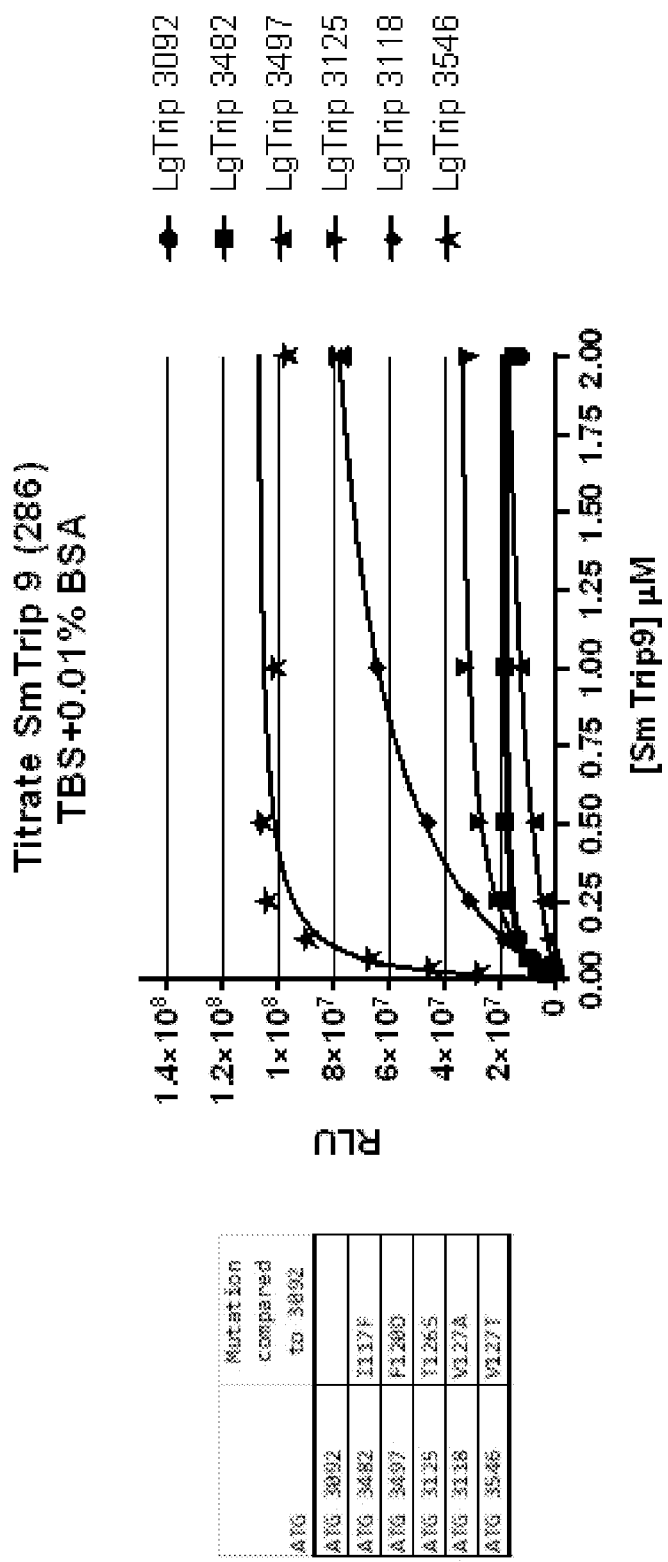
FIGS. 10A-C. Graphs depicting (A) titration of various LgTrip variants with SmTrip9 pep286 (SEQ ID NO: 37), (B) titration of various LgTrip variants with SmTrip10 pep86 (SEQ ID NO: 25), and (C) the affinity of various LgTrip variants for SmTrip9 pep286 and SmTrip10 pep86.
Figure 10B:
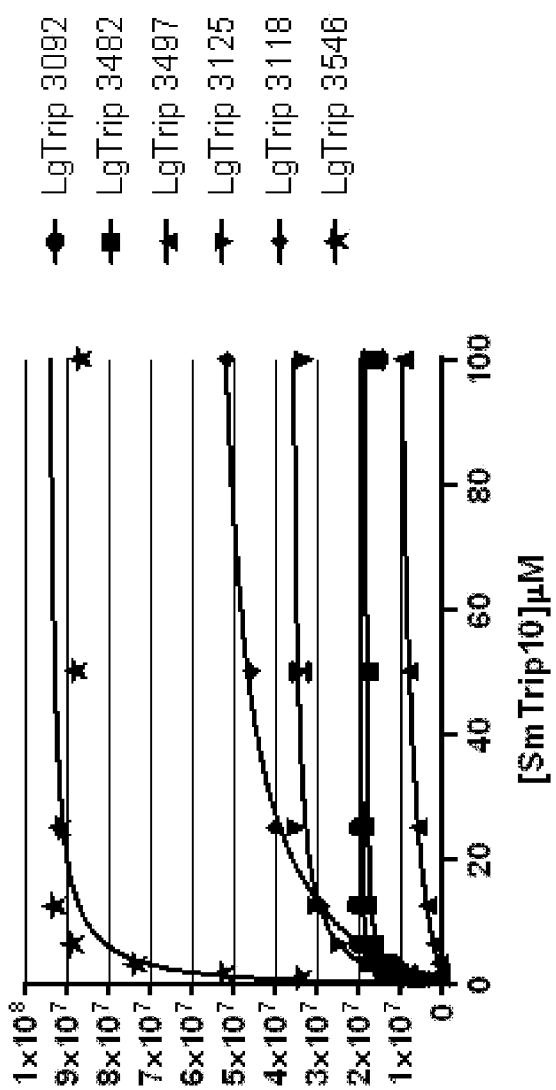
Figure 10C:
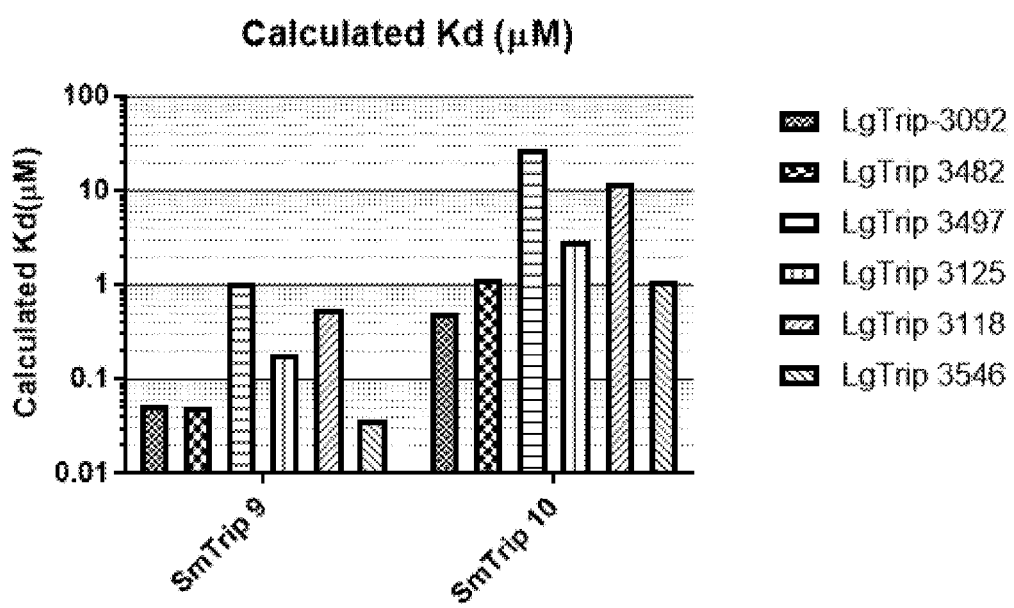

Experiments were conducted during development of embodiments herein to determine the affinity of various LgTrip variants for the SmTrip9- and SmTrip10-like peptides (FIG. 10).

For the SmTrip9 pep286 (SEQ ID NO: 37) titration, purified LgTrip samples were diluted to 2 nM in TBS+0.01% BSA+0.005% IGEPAL. Assay reagent containing TBS+0.01% BSA+0.005% IGEPAL+20 µM furimazine+200 µM SmTrip10 pep86 (SmHiTrip; SEQ ID NO: 25) was prepared. 4 uM of SmTrip9 pep286 (SEQ ID NO: 37) was added to the assay reagent and then serially diluted 500p to 500p in assay reagent containing Furimazine+200 µM SmTrip10 pep86 (HiBiT; SEQ ID NO: 15). 25 ul of each peptide titration was added to 25 ul of diluted LgTrip solution. Luminescence was read on a plate reader at 10 and 15 minutes.

For the SmTrip10 pep86 (SmHiTrip; SEQ ID NO: 25) titration, purified LgTrip samples were diluted to 2 nM in TBS+0.01% BSA+0.005% IGEPAL. Assay reagent containing TBS+0.01% BSA+0.005% IGEPAL+20 µM furimazine+4 µM SmTrip9 pep286 (SEQ ID NO: 37) was prepared. 200 uM of SmTrip10 pep86 (SmHiTrip; SEQ ID NO:25) was added to then assay reagent and then serially diluted 500p to 500p in assay reagent containing Furimazine+4 µM SmTrip9 pep286 (SEQ ID NO: 37). 25 ul of each peptide titration was added to 25 ul of diluted LgTrip solutions. Luminescence was read on plate reader at 10 and 15 minutes.

Example 13

Stability of LgTrip Variants (60° C.)

Figure 11A:
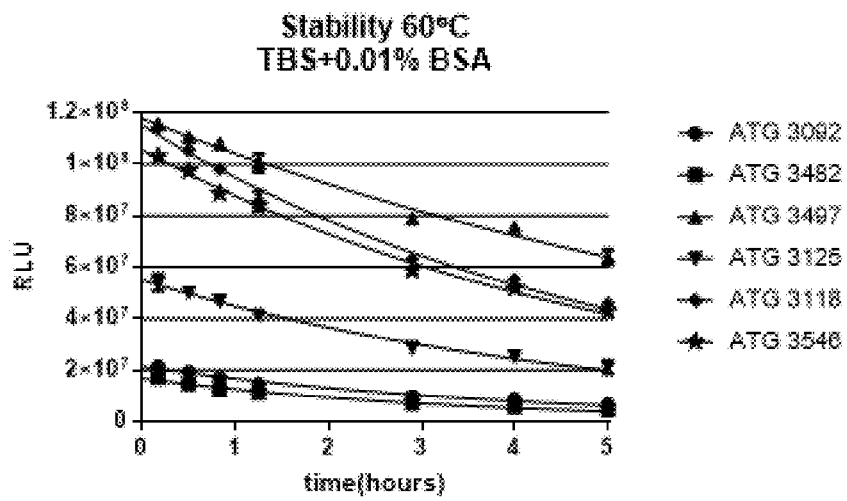
FIG. 11A-B. Graphs depicting the (A) stability (half-life) and (B) relative stability of various LgTrip variants at 60° C.
Figure 11B:
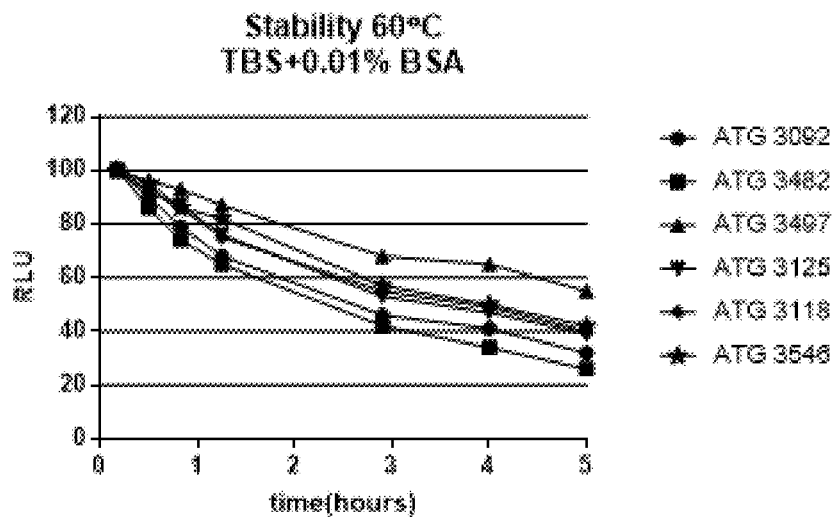

Experiments were conducted during development of embodiments herein to compare the stability of LgTrip variants at 60° C. (FIG. 11). Purified LgTrip mutants were diluted to 20 nM in TBS+0.01% BSA. 100 µl of each sample was aliquoted into 200 µl thin walled PCR tubes. Samples were incubated at 60° C. in thermal cycler and then were removed at various time-points, placed on ice, equilibrated to room temperature, and then diluted to 0.2 nM (5 µl in 495β1) in PLB lysis buffer (0.3× PLB+25 mM HEPES pH 7.5). 50p of each diluted sample was combined with 50p of 50 µM Furimazine+6 µM pep263 (SEQ ID NO: 35) in NanoGlo® buffer. Samples were incubated for 10 minutes and then read on GMM+. Half-life was calculated using GraphPad Prism non-linear regression (One-Phase Decay plateau set to zero).

Example 14

Comparison of Kinetic Profiles of LgBiT and LgTrip Variants

Figure 12A:
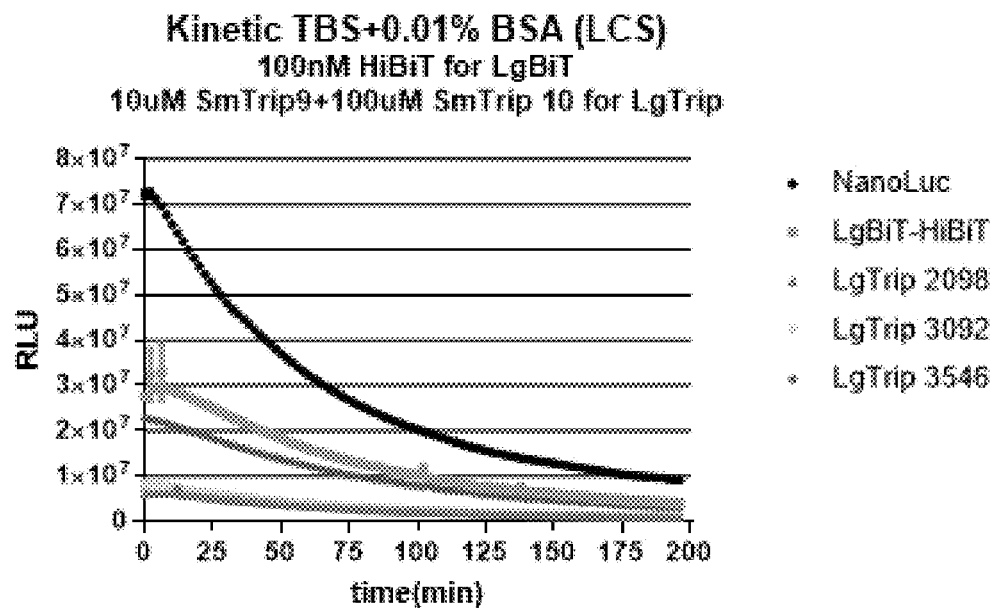
FIG. 12A-B. Graphs depicting the kinetic profiles of LgTrip variants in the presence of SmTrip9 pep286 (SEQ ID NO: 37) and SmTrip10 pep86 (HiBiT; SEQ ID NO: 25) compared to NanoLuc® (SEQ ID NO: 3) and LgBiT (SEQ ID NO: 11) and SmTrip10 pep86 (HiBiT; SEQ ID NO: 25) (A) assayed in TBS+0.01% BSA and (B) assayed with NanoGlo® assay buffer.
Figure 12B:
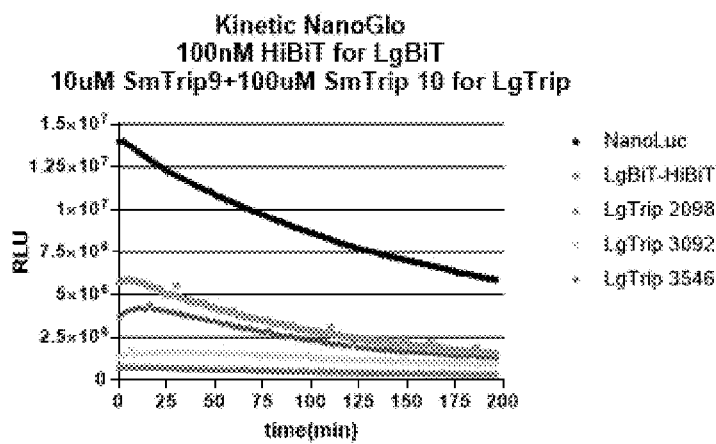

Experiments were conducted during development of embodiments herein to compare the kinetic profiles of various LgTrip variants with NanoLuc® luciferase (SEQ ID NO: 3) and a LgBiT (SEQ ID NO: 11)/HiBiT (SmTrip10 pep86) (SEQ ID NO: 25) two component system (FIG. 12). NanoLuc®, LgBiT, LgTrip 2098 (SEQ ID NO: 31), LgTrip 3092 (SEQ ID NO: 33), and LgTrip 3546 (SEQ ID NO: 51) were diluted to 20 µM in TBS+0.01% BSA+0.005% IGEPAL. Samples were diluted 1:100 (2 µl in 198 µl) and then 1:1000 (10 µl in 10 ml) or $10E^5$ dilution total to a 0.2 nM final concentration. To the LgBiT polypeptide, 200 nM of SmTrip10 pep86 (SmHiTrip; SEQ ID NO: 25) was added. To the LgTrip variants, 200 µM SmTrip10 pep86 (SmHiTrip; SEQ ID NO: 25) and 20 µM SmTrip9 pep286 (SEQ ID NO: 37) were added. Samples were incubated for 15 minutes, 50 ul of each enzyme/peptide dilution combined with either TBS+0.01% BSA+20 µM Live Cell Substrate (LCS; Promega Cat. No. N205) or NanoGlo® buffer+50 µM Furimazine, and immediately read on a GMM+luminometer.

Example 15

Detecting Protein-Protein Interactions with a Tripartite System

Figure 13A:
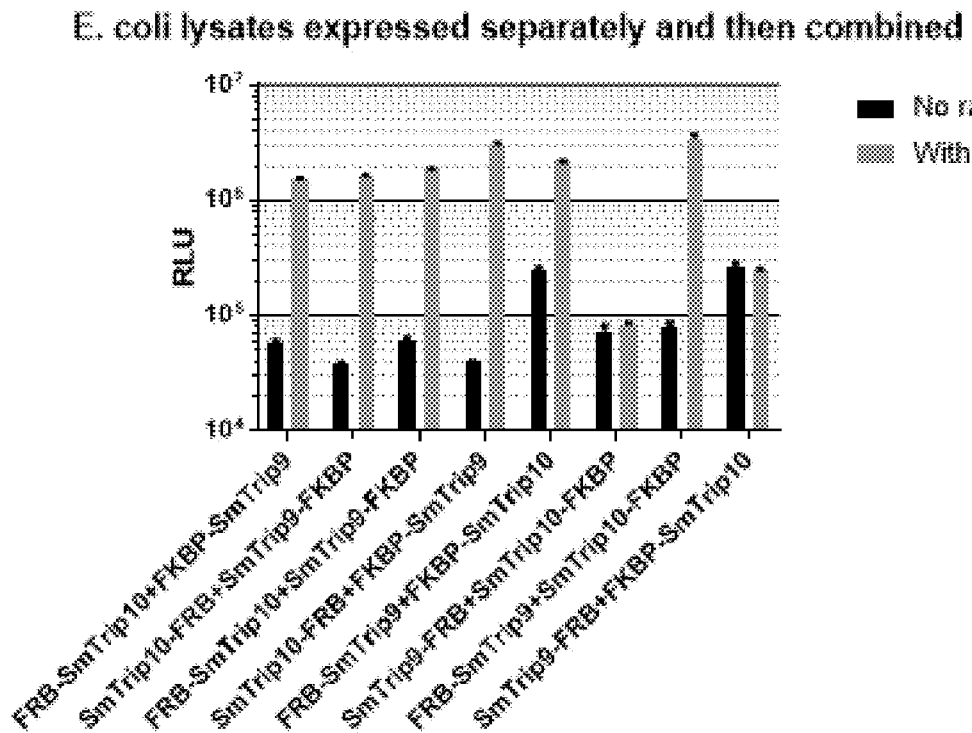
FIG. 13A-B. Graphs depicting facilitated complementation of various tripartite systems via rapamycin-induced formation of a FRB/FKBP complex: (A) SmTrip10 pep86 (SEQ ID NO:25), SmTrip9 pep245 (SEQ ID NO: 23), and LgTrip 2098 (SEQ ID NO: 31); and (B) SmBiT (SEQ ID NO: 13), SmTrip9 pep245 (SEQ ID NO: 23), and LgTrip 2098 (SEQ ID NO: 31).
Figure 13B:
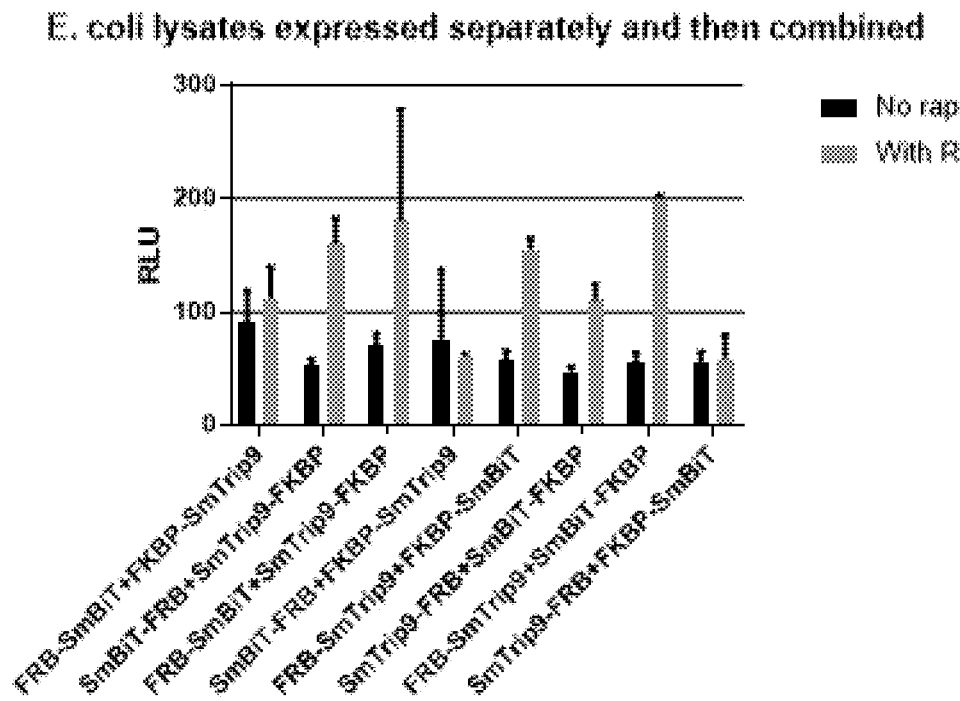

Experiments were conducted during development of embodiments herein to demonstrate the use of a tripartite complementation system in detecting protein-protein interactions (FIG. 13). Lysates containing FRB and FKBP fused to one each of SmTrip9 pep245 and SmTrip10 pep86 (FIG. 13A) or SmTrip9 pep245 and SmBiT (FIG. 13B) were added to purified LgTrip 2098 (SEQ ID NO: 31). Formation of the FRB/FKBP complex was induced with rapamycin and facilitated complementation of the tripartite system was monitored by luminescence.

Cell and lysate preparation. Cultures of each FRB-FKBP construct were grown overnight in LB+100 ug/ml ampicillin. Cultures were induced (30 µl in 3 ml of culture) in LB+0.1% rhamnose+0.15% glucose+100 ug/ml ampicillin and grow for 24 hours at 25° C. 200 µl of 10× Fastbreak Cell Lysis Reagent (Promega) was added to 2 ml of culture 0.001U/ml RQ1 DNase. Cultures were incubated for 30 min at 4° C. on a rotating mixer and then spun at 3500 rpm for 30 min. at 4° C. Cleared lysate was removed and placed into new tubes, frozen, and stored at −70° C.

Assay. Lysates were thawed, diluted 1:10 into TBS+0.1% BSA, and appropriate lysates combined. The lysates were divided, and 30 nM rapamycin was added to one of the aliquots. 25 µl of each lysate was combined with 25 µl of LgTrip 2098 (SEQ ID NO: 31), diluted to 200 nM in TBS+0.01% BSA, and incubated for one hour. 50 µl of NanoGlo® Buffer+50 µM furimazine was added, and luminescence was read on GMM+.

Example 16

Random Library Preparation and Screening

A random library of variant LgTrip polypeptides (using template LgTrip 2098) (SEQ ID NO: 31) was generated and screened for complementation with the β9/β10 dipeptide (SEQ ID NO: 35)(pep263).

Template DNA from LgTrip 2098 (SEQ ID NO: 32) was diluted to 10 ug/ml in water. Diversify™ PCR Random Mutagenesis Kit (63070-ClonTech) was used to prepare a random library of mutants. Library amplification products were band isolated and purified using WIZARD SV Gel and PCR Clean-Up System (A9281; Promega), cloned into pF4Ag, transformed into KRX competent cells (Promega), and plated onto LB agarose plates. Colonies were picked and place into wells of a 96-well plates with LB+ampicillin, and samples were grown overnight at 37° C. with shaking. Overnight cultures were diluted 1:20 into induction media (LB+0.1% Rhamnose+0.15% glucose+100 ug/ml ampicillin), and cultures were grown for 2-6 hours at 37° C. 10 ul of cells were added to 250 ul of PLB lysis buffer (0.3× PLB, 25 mM HEPES pH 7.0, 0.001U/ml DNase). 50 ul of cell lysate was combined with 50 ul of assay buffer (NanoGlo® buffer+50 uM Furimazine+0.2 nM of pep263). Plates were incubated for 5 minutes after reagent addition and then samples were read on ClarioStar luminometer. Clones that had improved luminescence compared to the template clone were selected for additional screening.

Approximately 6,000 LgTrip 2098-based variant clones were further screened, and favorable mutation sites were evaluated with site saturation mutagenesis. Favorable mutations following saturation mutagenesis were combined to derive the LgTrip clone LgTrip 3092 (SEQ ID NO: 19). Screening was repeated using LgTrip 3092 (SEQ ID NO: 19) as a template, and the resulting clone was LgTrip 3546 (SEQ ID NO: 51).

Example 17

Purification of LgTrip Clones 50 ml cultures of LgTrip mutants were induced in LB+0.1% Rhamnose+0.15% Glucose+amp. Cultures were spun and re-suspended in 4.5 ml of Hepes pH 7.5+0.001U/ml DNase. 500 ul of FastBreak™ Cell Lysis Reagent (Promega; V8571) was added, and samples were incubated on a rotating mixer for 1 hour at 4° C. Samples were spun to clear lysate, and supernatant was transferred to a new tube. Using the HisLink™ Spin Protein Purification System, 500 ul of HisLink™ Protein Purification Resin (Promega; V8821) was added to the samples, incubated for 2 hours at 4° C. on a rotating mixer, washed with HisLink wash/binding buffer, and eluted with elution buffer. Slide-A-Lyzer dialysis columns were used to exchange buffer to TBS.

Example 18

Stability Comparison

Figure 14A:
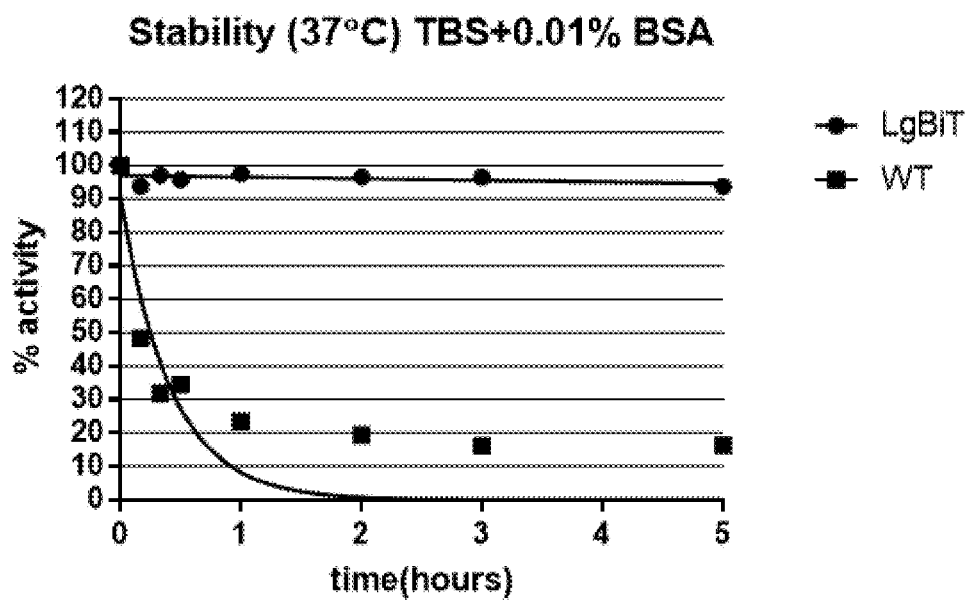
FIG. 14A-B. Graphs comparing the stability at 37° C. of LgBiT (SEQ ID NO: 11) and LgTrip 2098 (WT) (SEQ ID NO: 31 in (A) TBS+0.01% BSA and (B) Passive Lysis Buffer (PLB).
Figure 14B:
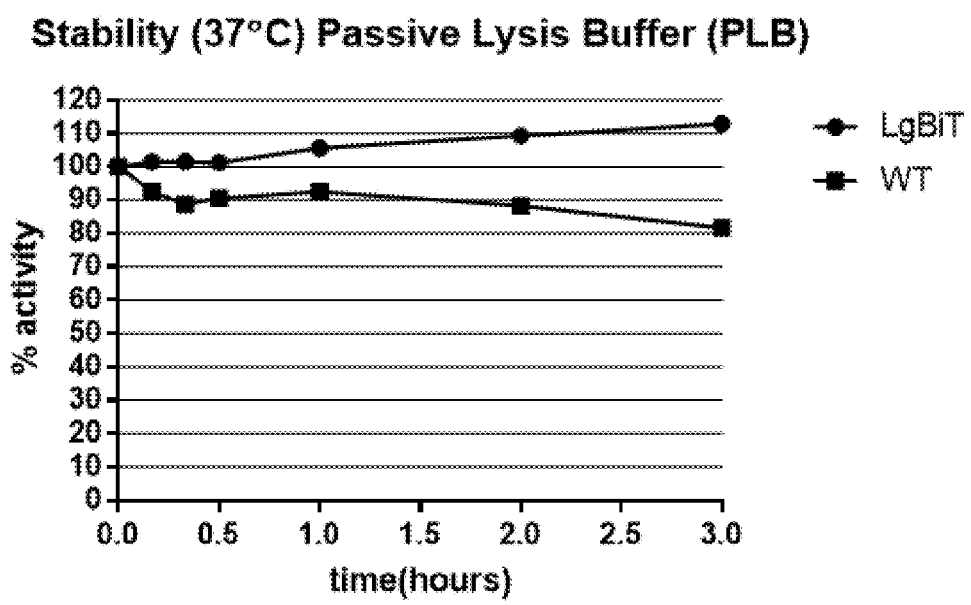

Experiments were conducted during development of embodiments herein to compare the stability of activity of LgBiT (SEQ ID NO: 11) and LgTrip 2098 (SEQ ID NO: 31) over time (FIG. 14). Diluted purified LgTrip 2098 and LgBiT to 20 nM in TBS+0.01% BSA or in 0.3× PLB+25 mM HEPES pH 7.5. Aliquoted 100 μl of each sample into 200 μl thin walled PCR tubes. Incubated samples at 37° C. in thermal cycler, removed at various time-points, and placed on ice. Samples were equilibrated to room temperature and then diluted each sample to 0.2 nM (5 μl in 495 μl) in PLB lysis buffer (0.3× PLB+25 mM HEPES pH 7.5). 50 μl of each diluted sample was combined with 50 μl of 50 μM Furimazine+6 μM pep263 (SEQ ID NO: 35) in NanoGlo® buffer. Samples were incubated for 10 minutes and then read on GMM+. Calculated half-life using GraphPad Prism non-linear regression (One-Phase Decay plateau set to zero).

Example 19

Stability of LgTrip in TBS+Minimal BSA Carrier

Figure 15A:
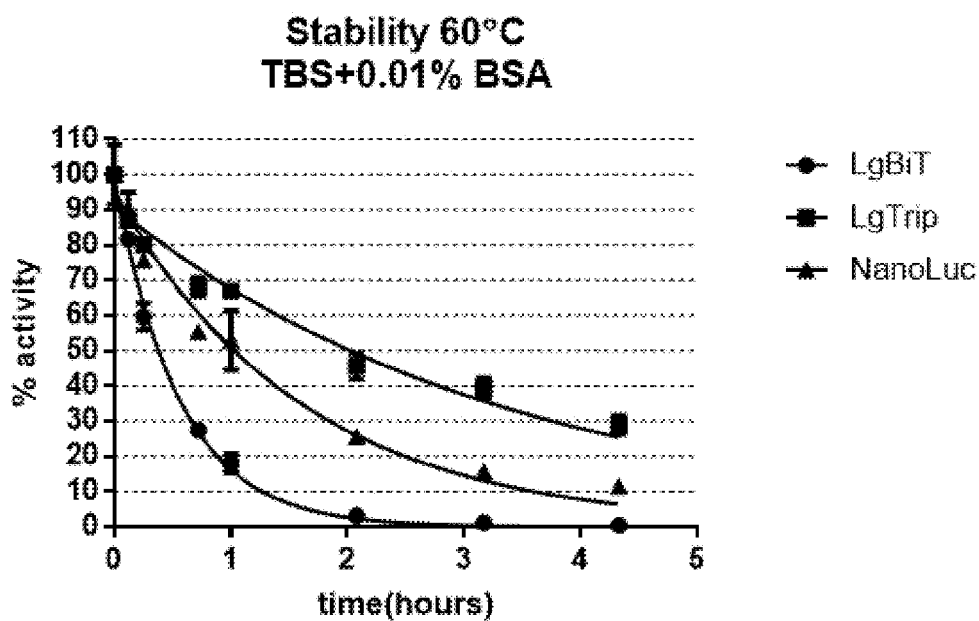
FIG. 15A-B. Graphs comparing stability of LgBiT (SEQ ID NO: 11), LgTrip 3546 (SEQ ID NO: 51), and NanoLuc® (SEQ ID NO: 31) at 60° C.; (A) time course and (B) half-life.
Figure 15B:
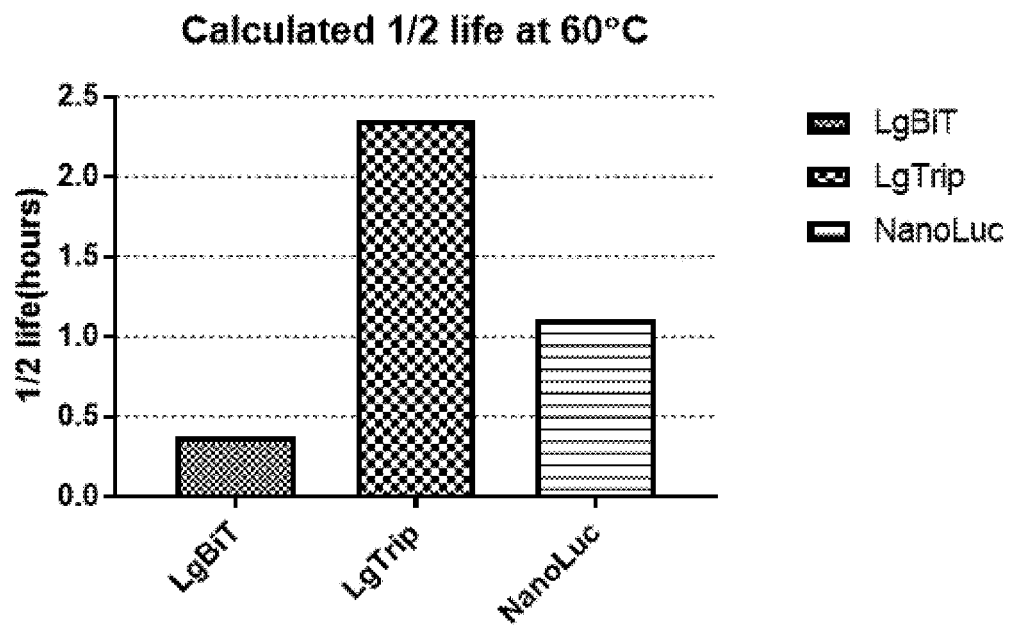

Experiments were conducted during development of embodiments herein to determine the stability of the activity of NanoLuc® (SEQ ID NO: 3), LgBiT (SEQ ID NO: 11), and LgTrip 3546 (SEQ ID NO: 51) in TBS and a minimal BSA carrier over time (FIG. 15). NanoLuc®, LgBiT, and LgTrip 3546 were diluted to 20 nM in TBS+0.01% BSA. 100 μl of each were aliquoted into 200 μl thin walled PCR tubes. Samples were incubated at 60° C. in thermal cycler, removed at various time-points, and placed on ice. Samples were equilibrated to room temperature and diluted to 0.2 nM (5 μl in 495 μl) in PLB lysis buffer (0.3× PLB+25 mM HEPES pH 7.5). 50 μl of each diluted sample was combined with 50 μl of 50 μM Furimazine+6 μM pep263 (SEQ ID NO: 35) in NanoGlo® buffer. Samples were incubated for 10 minutes and then read on GMM+. Half-life was calculated using GraphPad Prism non-linear regression (One-Phase Decay plateau set to zero).

Example 20

Effect of Salt on Activity

Figure 16A:
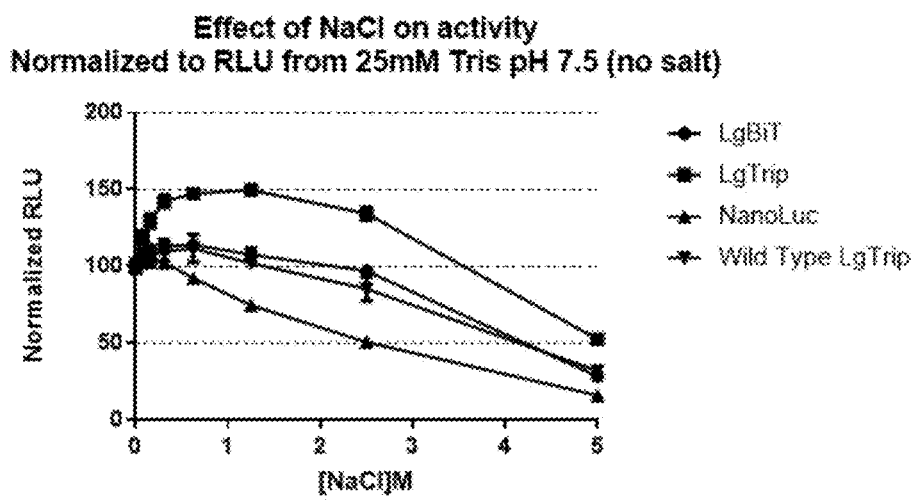
FIG. 16A-B. Graphs comparing LgBiT (SEQ ID NO: 11), NanoLuc® (SEQ ID NO: 3), and LgTrip 3546 (SEQ ID NO: 51), and LgTrip 2098 (WT) (SEQ ID NO: 31) (A) in the presence NaCl and (B) after 26 hour exposure to NaCl.
Figure 16B:
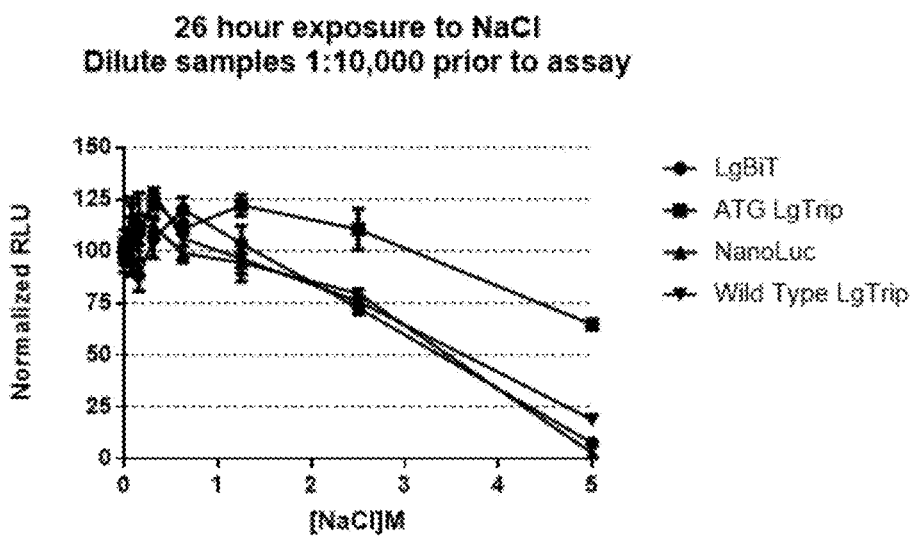

Experiments were conducted during development of embodiments herein to determine the effect of salt concentration on the activity of NanoLuc® (SEQ ID NO: 3), LgBiT (SEQ ID NO: 11) LgTrip 2098 (SEQ ID NO: 31) and LgTrip 3546 (SEQ ID NO: 51) (FIG. 16).

To test activity in the presence of salt, each enzyme was diluted to 1 uM in TBS+0.01% BSA+0.01% Tergitol, and further diluted to 2 nM in TBS+0.01% BSA+0.01% Tergitol. 4 uM of pep 263 (SEQ ID NO: 35) was added to LgBiT, LgTrip 3546 (SEQ ID NO: 51), and LgTrip 2098 (SEQ ID NO: 31) and incubated for 30 minutes. A two-fold titration series was prepared for each, starting with 5M NaCl in 25 mM Tris pH 7.5+0.01% Tergitol. 10 uM furimazine was added to each sample of the titration series, and 5 ul of each enzyme or enzyme+pep263 (SEQ ID NO: 35) were combined with 45 ul of each substrate additive mixture. Plates were incubated for 3 minutes and then read on GMM+.

To test the effect of prolonged exposure to salt, each enzyme was diluted to 1 uM, and a two-fold titration series was prepared starting with 5M NaCl in 25 mM Tris pH 7.5+0.01% Tergitol. 2 ul of each enzyme was added to 198 ul of the NaCl titration (10 nM final of each enzyme). The "no" additive control was TBS+0.01% BSA+0.01% Tergitol. Samples were incubated for 26 hours. After incubation, samples were diluted 1:10,000 into TBS+0.01% BSA+0.01% Tergitol (10 ul in 990 two times). 4 uM pep263 (SEQ ID NO: 35) was added to LgTrip 2098 (SEQ ID NO: 31), LgTrip 3546 (SEQ ID NO: 51), and LgBiT (SEQ ID NO: 11) in the second dilution. 50 ul of each sample was combined with 50 ul of NanoGlo® buffer+50 uM Furimazine. Plates were incubated for 3 minutes and then read on GMM+.

Example 21

Effect of Urea on Activity

Figure 17A:
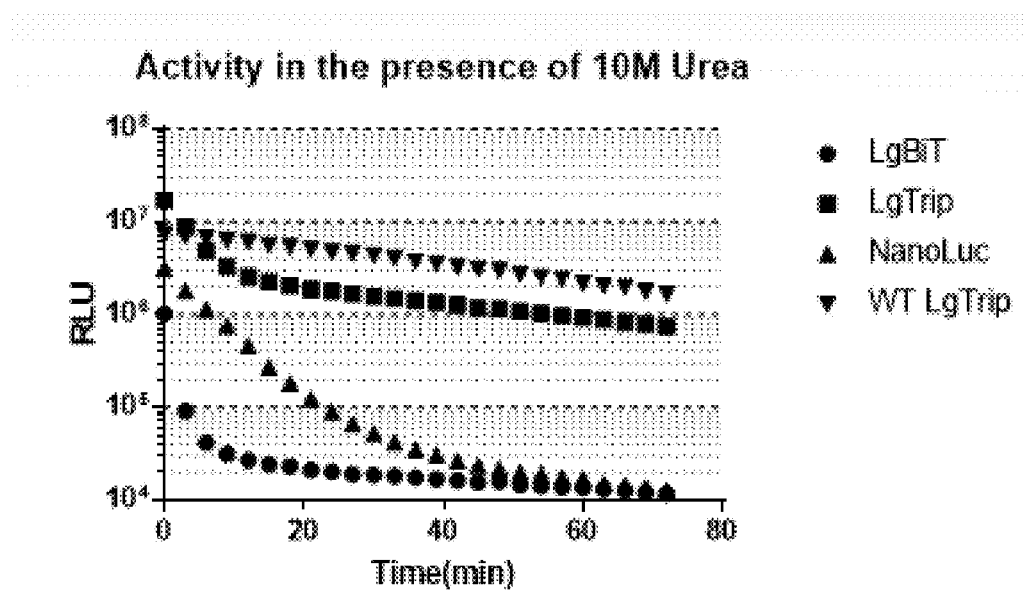
FIG. 17A-B. Graphs comparing LgBiT (SEQ ID NO: 11), NanoLuc® (SEQ ID NO: 3), and LgTrip 3546 (SEQ ID NO: 51) and LgTrip 2098 (WT) (SEQ ID NO: 31) variants (A) in the presence urea and (B) after 26 hour exposure to urea.
Figure 17B:
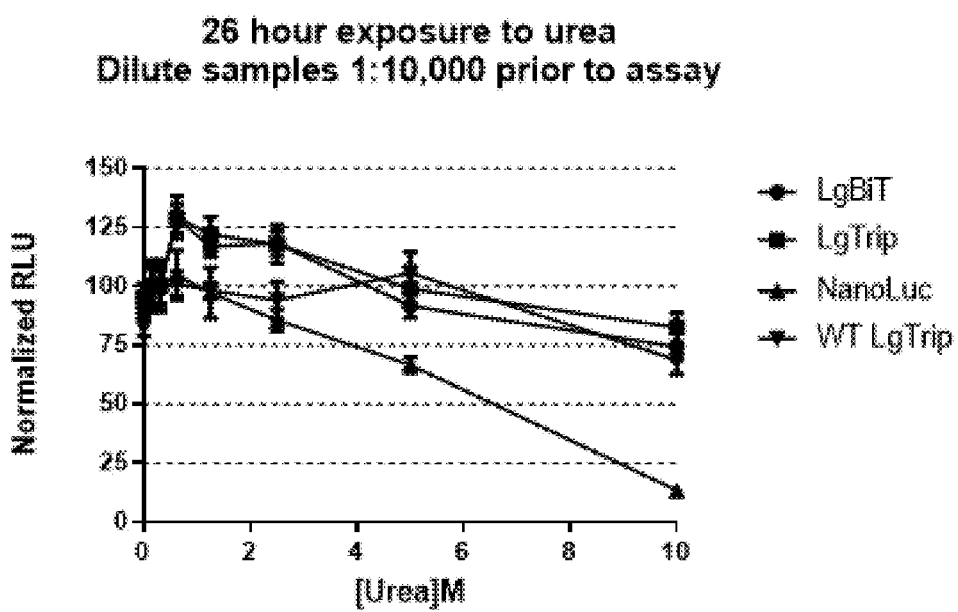

Experiments were conducted during development of embodiments herein to determine the effect of urea concentration on the activity of NanoLuc® (SEQ ID NO: 3), LgBiT (SEQ ID NO: 11), LgTrip 2098 (SEQ ID NO: 31), and LgTrip 3546 (SEQ ID NO: 51) (FIG. 17).

To test activity in the presence of urea, each enzyme was diluted to 1 uM in TBS+0.01% BSA+0.01% Tergitol and further diluted to 2 nM in TBS+0.01% BSA+0.01% Tergitol. 4 uM of pep263 (SEQ ID NO: 35) was added to LgBiT (SEQ ID NO: 11), LgTrip 3546 (SEQ ID NO: 51), and LgTrip 2098 (SEQ ID NO: 31) and incubated for 30 minutes. A two-fold titration series was prepared for each, starting with 10 M urea in 25 mM Tris pH 7.5+0.01% Tergitol. 10 uM furimazine was added to each sample of the titration series, and 5 ul of each enzyme or enzyme+pep263 (SEQ ID NO:

35) were combined with 45 ul of each substrate additive mixture. Plates were incubated for 3 minutes and then read on GMM+.

To test the effect of prolonged exposure to urea, each enzyme was diluted to 1 uM, and a two-fold titration series was prepared starting with 10 M urea in 25 mM Tris pH 7.5+0.01% Tergitol. 2 ul of each enzyme was added to 198 ul of the urea titration (10 nM final of each enzyme). The "no" additive control was TBS+0.01% BSA+0.01% Tergitol. Samples were incubated for 26 hours. After incubation, samples were diluted 1:10,000 into TBS+0.01% BSA+ 0.01% Tergitol (10 ul in 990 ul two times). 4 uM pep263 (SEQ ID NO: 35) was added to LgTrip 2098 (SEQ ID NO: 31), LgTrip 3546 (SEQ ID NO: 51), and LgBiT (SEQ ID NO: 11) in the second dilution. 50 ul of each sample was combined with 50 ul of NanoGlo® buffer+50 uM Furimazine. Plates were incubated for 3 minutes and then read on GMM+.

The results demonstrate that NanoLuc® and NanoBiT® are more susceptible to inactivation by urea compared to LgTrip 3546, while LgTrip 2098 is the least effected by urea. The exposure results demonstrate that LgTrip 3546, LgTrip 2098, and LgBiT regain activity upon prolonged treatment with urea indicating that activity of these polypeptide may be negatively affected by contaminating proteins, and that denaturation of these contaminants enhances activity.

Example 22

Effect of pH on Activity

Figure 18A:
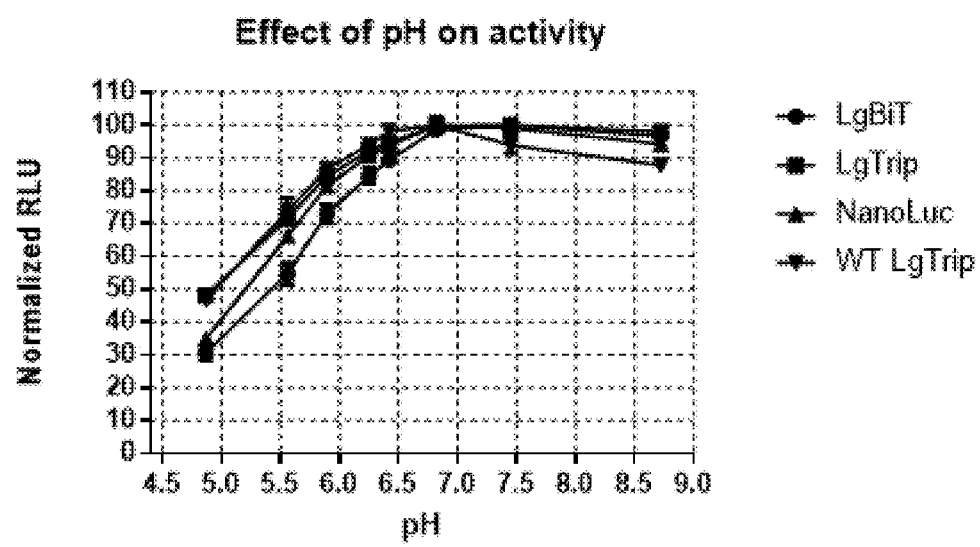
FIG. 18A-B. Graphs comparing LgBiT (SEQ ID NO: 11), NanoLuc® (SEQ ID NO: 3), and LgTrip 3546 (SEQ ID NO: 51) and LgTrip 2098 (WT) (SEQ ID NO: 31) variants (A) at varying pH and (B) after 26 hour exposure to varying pH.
Figure 18B:
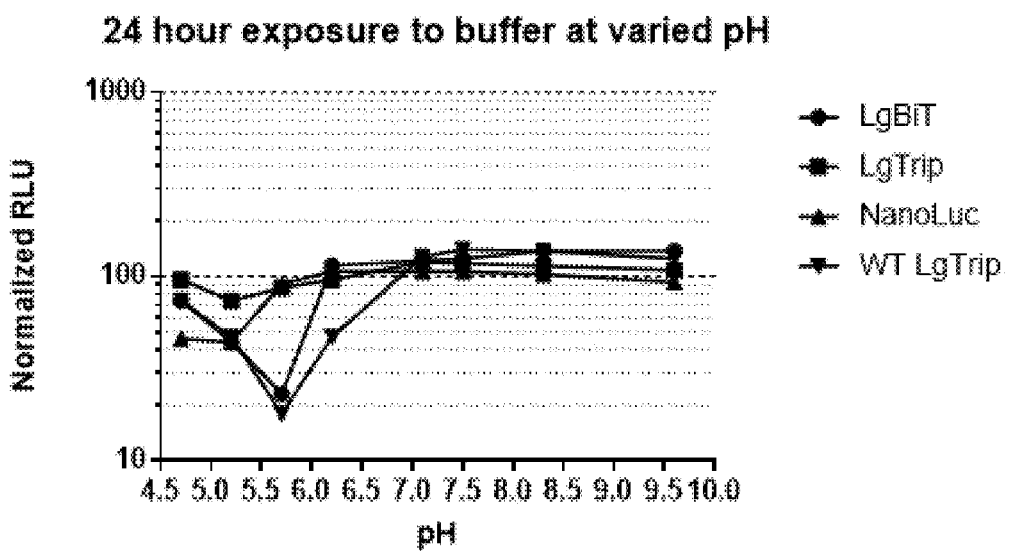

Experiments were conducted during development of embodiments herein to determine the effect of pH on the activity of NanoLuc® (SEQ ID NO: 3), LgBiT (SEQ ID NO: 11), LgTrip 2098 (WT) (SEQ ID NO: 31), and LgTrip 3546 (SEQ ID NO: 51) (FIG. 18).

A universal buffer was prepared containing 25 mM of each: NaCitrate, MES, PIPES, HEPES, TAPS, and Thiourea in 0.5% Tergitol. The buffer was divided into 8 aliquots of 20 ml, and NaOH or HCl was added to create a pH titration series.

To test effect of pH on activity, each enzyme was diluted to 1 uM and then diluted to 0.4 nM in 3 ml of TBS+0.01% BSA+0.01% Tergitol. 4 uM pep263 (SEQ ID NO: 35) was added to LgBiT, LgTrip 2098, and LgTrip 3546. Assay reagent for each pH buffer tested (Table 5) (20 ul of furimazine in 980 of buffer). 10 ul of each enzyme/peptide dilution was combined with 50 ul of assay reagent. Plates were incubated for 3 minutes and read on GMM+.

TABLE 5

Buffers.

| Component | M(g/mol) | g |
|---|---|---|
| Na Citrate | 294.1 | 1.47 |
| MES | 195.24 | 0.98 |
| PIPES | 302.37 | 1.51 |
| Hepes | 238.3 | 1.19 |
| TAPS | 243.3 | 1.22 |
| Thiourea | 76.12 | 0.53 |

To test the effect of prolonged exposure varying pH, each enzyme was diluted to 1 uM in TBS+0.01% BSA+0.01% Tergitol, which was then diluted to 20 nM in each buffer. T=0 samples were mixed and then diluted 1:10 into 200 mM HEPES pH 7.5+0.01% BSA+0.01% Tergitol and stored at 4° C. T=8 samples were mixed and then diluted 1:10 into 200 mM HEPES pH 7.5+0.01% BSA+0.01% Tergitol store at 4° C. T=24 samples were mixed and then diluted 1:10 into 200 mM HEPES pH 7.5+0.01% BSA+0.01% Tergitol store at 4° C. To perform the assay, LgTrip and LgBiT were diluted 1:10 in TBS+0.01% BSA+0.01% Tergitol+4 uM SmTrip10 pep286 (SEQ ID NO: 35), and NanoLuc® was diluted into TBS+0.01% BSA+0.01% Tergitol. 40 ul of each sample was diluted with 40 ul of NanoGlo® buffer+40 uM furimazine, incubated for 3 minutes, and then read on GMM+.

The results indicate that LgTrip is resistant to a wide pH range.

Example 23

Autoluminescence

Figure 19:
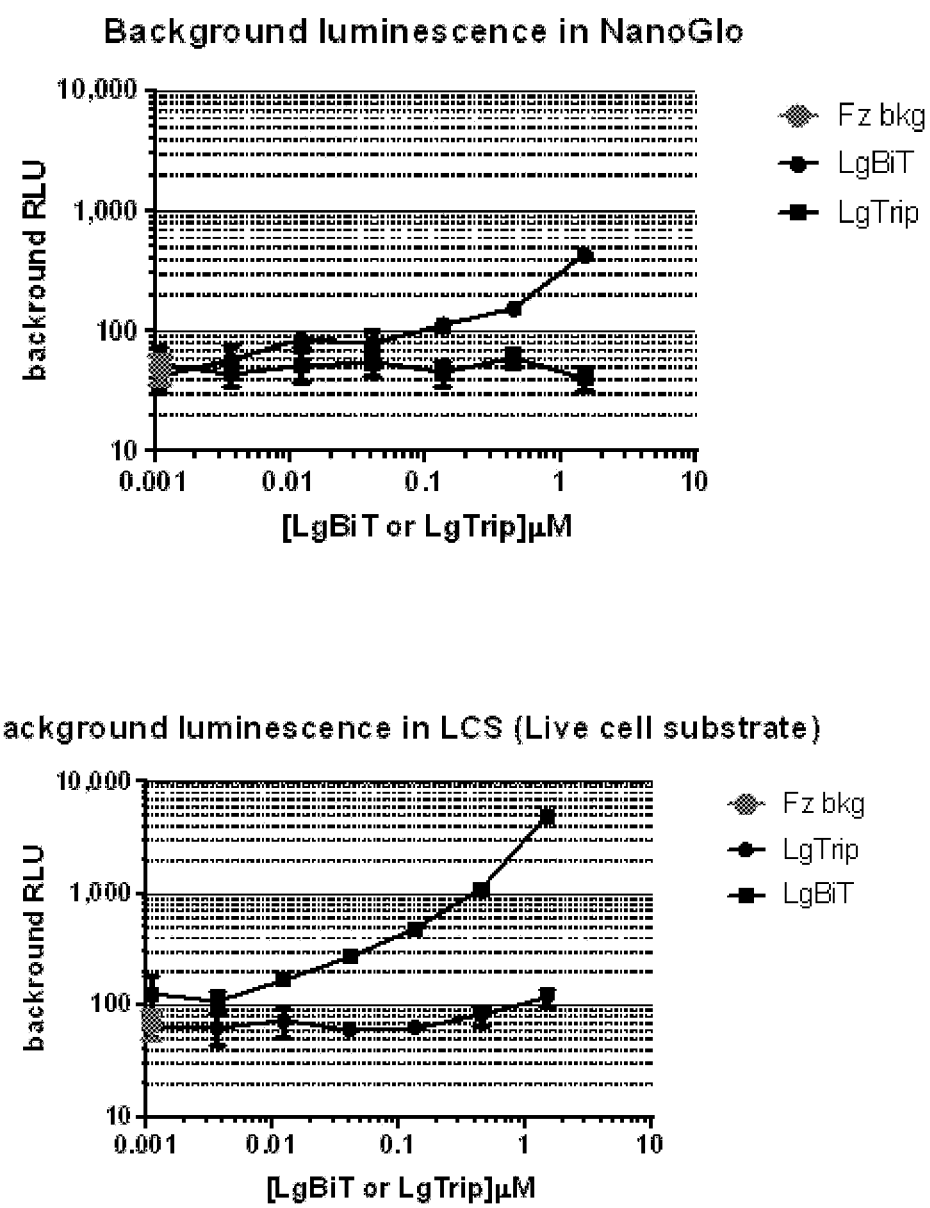
FIG. 19. Graph comparing the auto luminescence of LgBiT (SEQ ID NO: 11) and LgTrip 3546 (SEQ ID NO: 51).

Experiments were conducted during development of embodiments herein to compare the autoluminescence of LgBiT (SEQ ID NO: 11) and LgTrip 3546 (SEQ ID NO: 51). Each was diluted to 3 uM in DPBS+0.01% BSA. Three-fold serial dilutions were prepared of each in DPBS+0.01% BSA (300 ul to 700 ul) and placed in wells of a 96-well plate. The last row of the plate contained the furimazine controls (n=12). 50 ul of each titration (or controls) were combined with 50 ul of NanoGlo® buffer+50 uM furimazine, incubated for 3 minutes, and then read on GMM+. LgTrip (i.e., LgTrip 3546) exhibited significantly reduced autoluminescence compared to LgBiT (FIG. 19).

Example 24

Complementation of LgTrip with β9/β10 Dipeptide

Figure 20A:
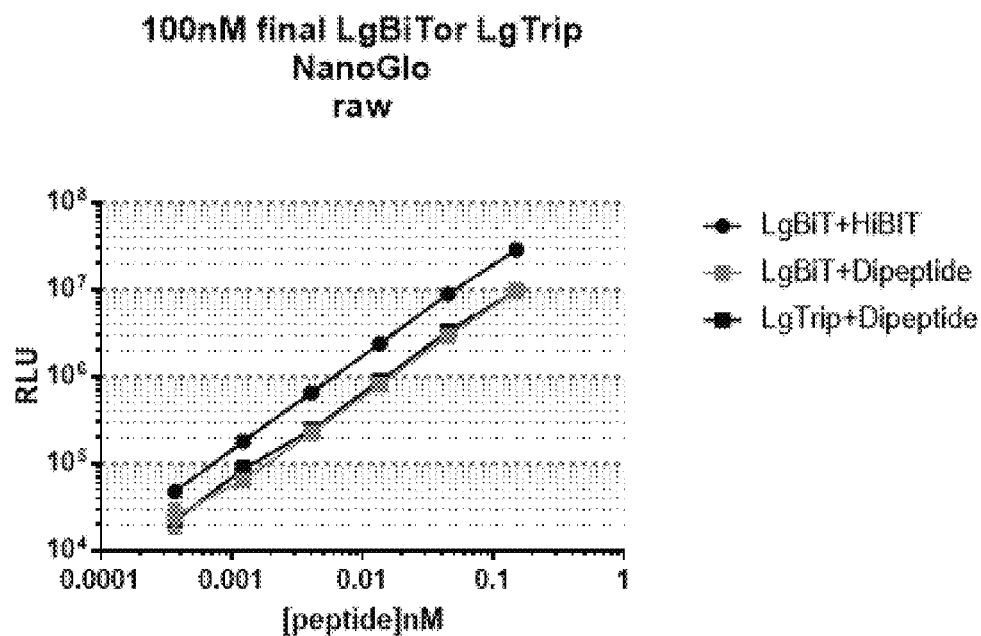
FIG. 20A-B. Graph comparing the luminescence of LgBiT (SEQ ID NO: 11)+SmTrip 10 pep86 (HiBiT; SEQ ID NO: 25), LgBiT (SEQ ID NO: 11)+pep263 (SEQ ID NO: 35) (β9/β10 dipeptide), and LgTrip 3546 (SEQ ID NO: 51)+pep263 (β9/β10 dipeptide) (SEQ ID NO: 35): (A) RLU and (B) signal/background (S/B).
Figure 20B:
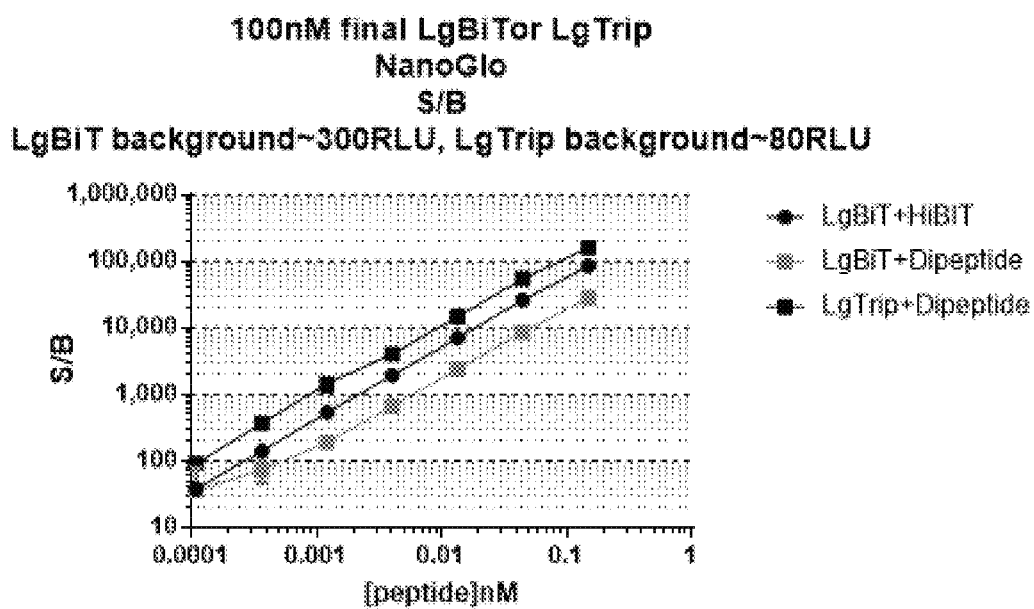

Experiments were conducted during development of embodiments herein to determine the capacity of a β9/β10 dipeptide (e.g., pep263) (SEQ ID NO: 35) to form a bioluminescent complex with either LgTrip 3546 (SEQ ID NO: 51) or LgBiT (SEQ ID NO: 11). The luminescence of such a complex was compared with the luminescence of complexes of LgTrip 3546 with 39/310 dipeptide and LgBiT with either SmTrip10 pep86 (SmHiTrip; SEQ ID NO: 25) or the dipeptide, pep263 (SEQ ID NO: 35) (FIG. 20).

SmTrip10 pep86 (SmHiTrip; SEQ ID NO: 25) and pep263 (SEQ ID NO: 35) were diluted to 2 nM in H$_2$O. A 3× dilution series was prepared of each peptide in TBS+ 0.01% BSA starting at 300 nM. Solutions of 200 nM LgTrip 3546 and LgBiT were prepared in NanoGlo® buffer+50 uM furimazine (NanoGlo® reagent). 50 ul of each titration were combined with 50 ul of each NanoGlo® reagent, and luminescence was read after a five minute incubation. Signal/background was calculated by dividing the amount of peptide dependent RLU by the background reading. Results demonstrate that the dipeptide has a $K_d$ 2-3× higher than HiBiT which accounts for lower RLU at low peptide concentration. The background of LgBiT decreases signal to background. RLU values for LgBiT/dipeptide and LgTrip/ dipeptide were equal.

Example 25

Comparison of LgTrip 2098 & LgTrip 3546 complementation with SmTrip10 and SmTrip9

Figure 21A:
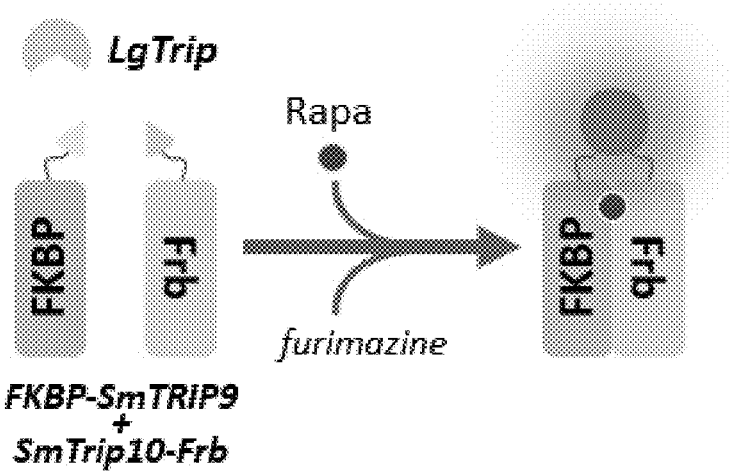
FIG. 21A-C. Facilitated complementation of LgTrip 2098 (SEQ ID NO: 31) and LgTrip 3546 (SEQ ID NO: 51), respectively with SmTrip10 pep86 (SEQ ID NO: 25) and SmTrip9 pep245 (SEQ ID NO: 23): (A) schematic of assay system, (B) RLU, and (C) signal/background (S/B).
Figure 21B:
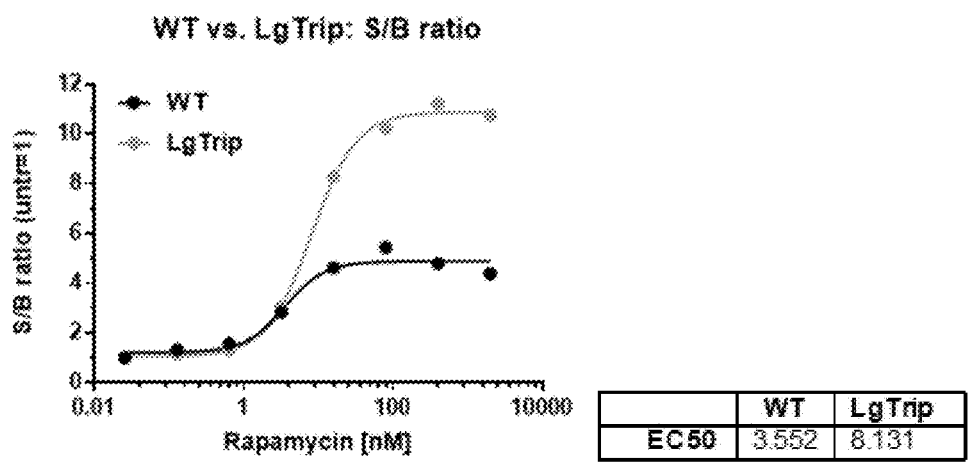
Figure 21C:
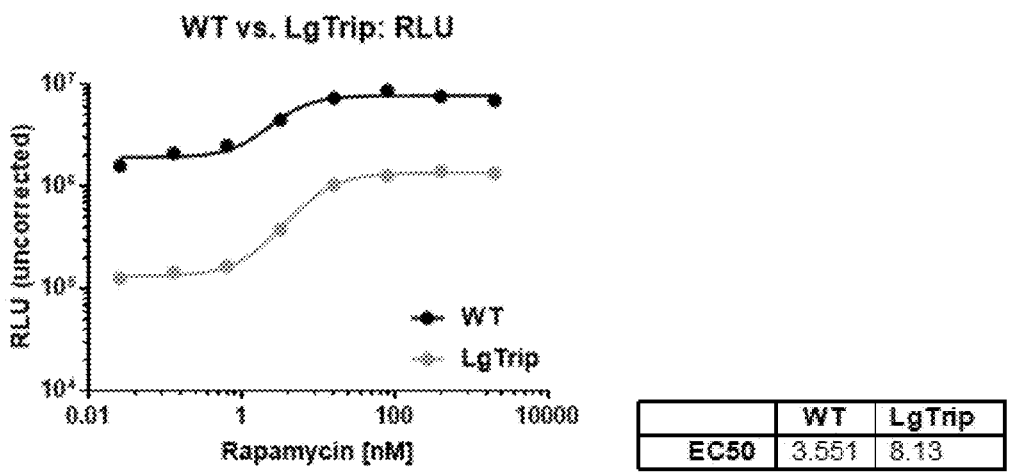

Experiments were conducted during development of embodiments herein to demonstrate complementation of LgTrip 2098 (SEQ ID NO: 31) & LgTrip 3546 (SEQ ID NO: 51), respectively, with SmTrip10 and SmTrip9 peptides, facilitated by the rapamycin-induced binding of SmTrip9 pep245-bound FKBP to SmTrip10 pep86-bound Frb (FIG. 21). FKBP-SmTrip9 pep245, SmTrip10 pep86-Frb, and LgTrip 3546 or LgTrip 2098 were transiently transfected into HEK293 cells (20,000 cells per well/96-well plate). Samples were exposed to serial dilutions of rapamycin (to induce FKBP/Frb complex formation) and 10 μM furimazine, and luminescence was measured. Results demonstrate that the affinity of SmTrip10 pep86 is ~10× lower for LgTrip 3546 compared to LgTrip 2098.

Example 26

Affinity of Various SmTrip10 Sequences

Figure 22:
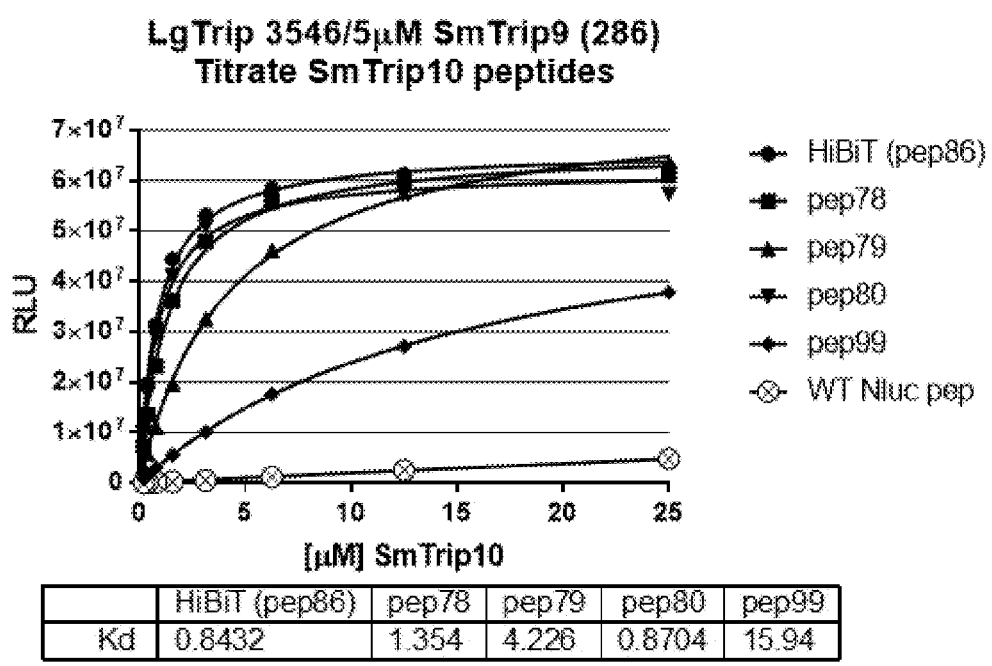
FIG. 22. Graph and table comparing the affinities of various SmTrip10 sequences for LgTrip 3546 (SEQ ID NO: 51) and SmTrip9 pep286 (SEQ ID NO: 37).

Experiments were conducted during development of embodiments herein forming luminescent complexes between various SmTrip10 pep286 (HiBiT; SEQ ID NO: 25) sequences and LgTrip 3546 (SEQ ID NO: 51)/SmTrip9 pep286 (SEQ ID NO: 37) (FIG. 22). Enzymes were diluted to 200 nM in TBS+0.01% BSA+0.01% Tergitol, serial dilutions (100 ul into 900 ul) were prepared in TBS+0.01% BSA+0.01% Tergitol (2× to make 2 nM), and 2 nM sample was diluted 1:10 into TBS+0.01% BSA+0.01% Tergitol (500 ul into 4.5 ml).

A 2× dilution series was prepared of each SmTrip10-like peptide in TBS+0.01% BSA+0.01% Tergitol+20 uM of SmTrip9 pep286 (SEQ ID NO: 37) starting at 100 uM. 50 ul of diluted LgTrip 3546 (SEQ ID NO: 51) was combined with 50 ul of the peptide titration and incubated for 10 minutes at room temperature. 100 ul of TBS+0.01% BSA+ 0.01% Tergitol+20 uM Furimazine was added to each sample, samples incubated for 10 minutes, and then read on GMM+.

Example 27

Inverse Dipeptide

Figure 23:
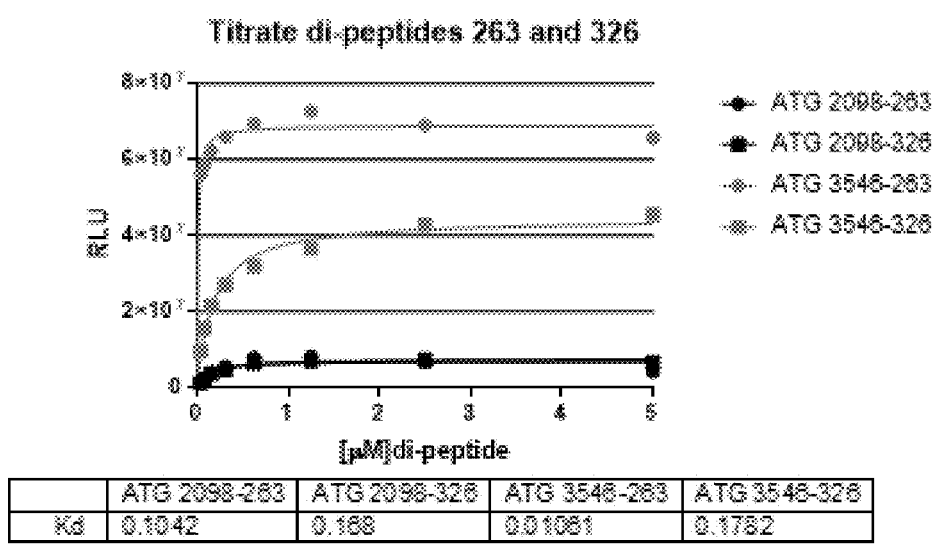
FIG. 23. Graph and table comparing the activation of LgTrip 2098 (SEQ ID NO: 31) and LgTrip 3546 (SEQ ID NO: 51) by standard-orientation (pep263) (SEQ ID NO: 35) and inverse-orientation (pep326) (SEQ ID NO: 179) dipeptides.

Experiments were conducted during development of embodiments herein to compare the capacity of dipeptides having opposite beta strand order (e.g., 39-β10 vs. β10-β9) to activate complement polypeptides (FIG. 23). LgTrip 3546 (SEQ ID NO: 51) and LgTrip 2098 (SEQ ID NO: 31) were diluted to 200 nM in TBS+0.01% BSA+0.01% Tergitol, and serial dilutions of each were prepared (100 ul into 900 ul) in TBS+0.01% BSA+0.01% Tergitol. The 2 nM sample was diluted 1:10 into TBS+0.01% BSA+0.01% Tergitol (500 ul into 4.5 ml). 20 uM stocks of each dipeptide (pep326 (SEQ ID NO: 179) and pep263 (SEQ ID NO: 35)) were prepared in TBS+0.01% BSA+0.01% Tergitol. 2× serial dilutions of each peptide were prepared TBS+0.01% BSA+0.01% Tergitol (250 ul in 250 ul). 50 ul diluted LgTrip 2098 and LgTrip 3546 was combined with 50 ul of the each peptide series and incubated at room temperature for 20 minutes. 100 ul of LCS (Live cell substrate; Promega Catalog No. N205) in TBS (20 uM) was added, and samples were incubated for 3 minutes and then read on GMM+.

Example 28

Figure 24:
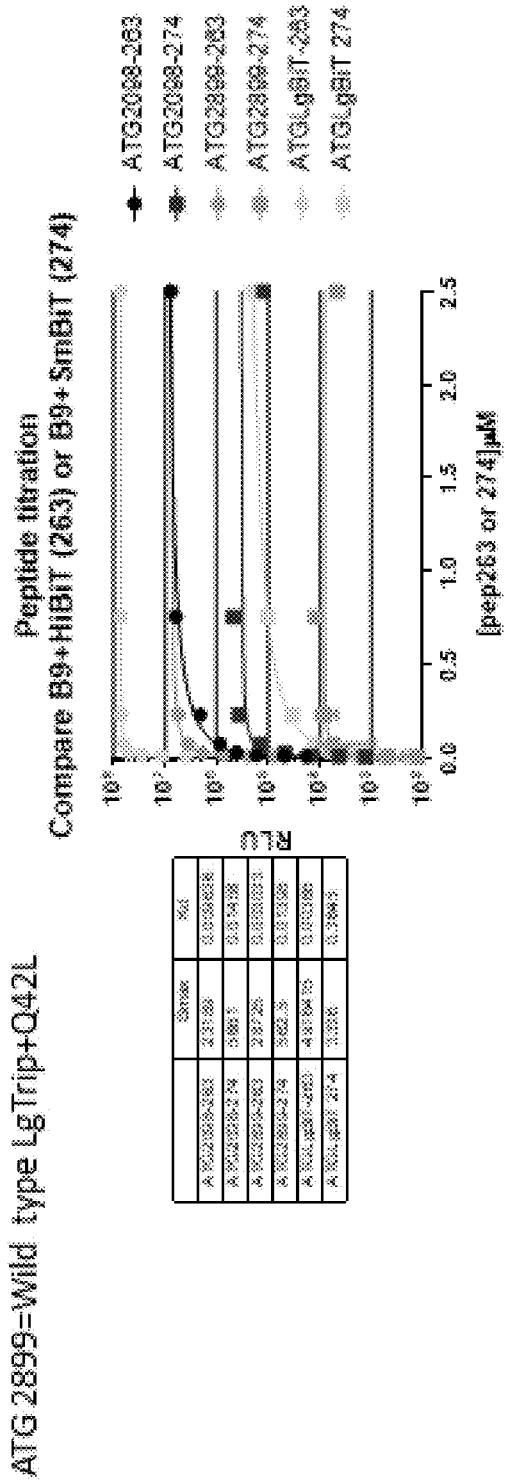
FIG. 24. Graph and table depicting activation of complement polypeptides by dipeptides comprising the HiBiT or SmBiT sequence. Dipeptide with HiBiT sequence pep263 (SEQ ID NO: 35) or Dipeptide with SmBiT sequence pep274 (SEQ ID NO: 147) FIG. 25A-B. (A) Graph depicting luminescence resulting from complementation of various combinations of polypeptide components (with additions or deletions relative to LgTrip 3546) with SmTrip9 pep286 (SEQ ID NO: 37) and various β10-like peptides (SmTrip10 peptides); (B) Graph depicting luminescence resulting from complementation of LgTrip 3546 (SEQ ID NO: 51) and SmTrip9 pep286 (SEQ ID NO: 37) with various β10-like peptides (SmTrip10 peptides).

Comparison of dipeptides comprised of SmTrip9 (SEQ ID NO: 23) and either SmHiTrip (SEQ ID NO: 25) or SmBiT (SEQ ID NO: 13) for the SmTrip10 component Experiments were conducted during development of embodiments herein to compare the capacity of dipeptides comprising the SmHiTrip (SEQ ID NO:25) or SmBiT (SEQ ID NO: 13) sequence to activate complement polypeptides (FIG. 24). LgBiT, LgTrip 2098, and LgTrip 2899 (SEQ ID NO: 364) were diluted to 200 nM into TBS+0.01% BSA.

Polypeptides were further diluted 1:100 into NanoGlo® buffer+50 uM Furimazine (30 ul in 3 ml). Pep263 (SEQ ID NO: 35) and pep274 (SEQ ID NO: 147) were diluted into TBS+0.01% BSA to 5 uM. 50 ul of each LgBiT/LgTrip dilution were combined with 50 ul of peptide dilution, incubated 5 minutes, and then read on GMM+.

Example 29

Additions/Deletions of C-Terminus of LGTrip 3546

Figure 25A:
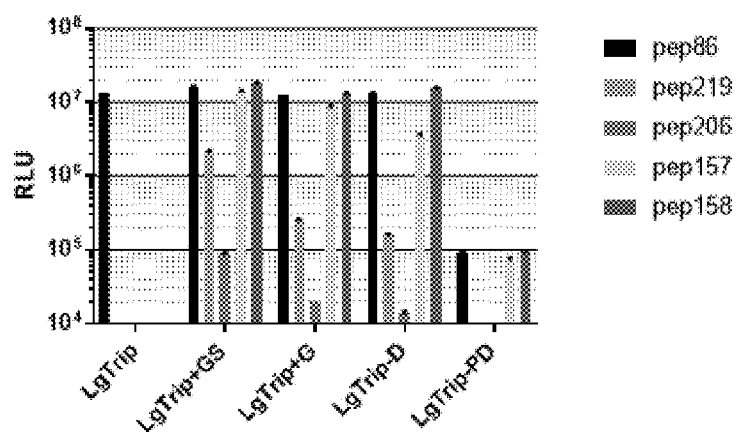
Figure 25B:
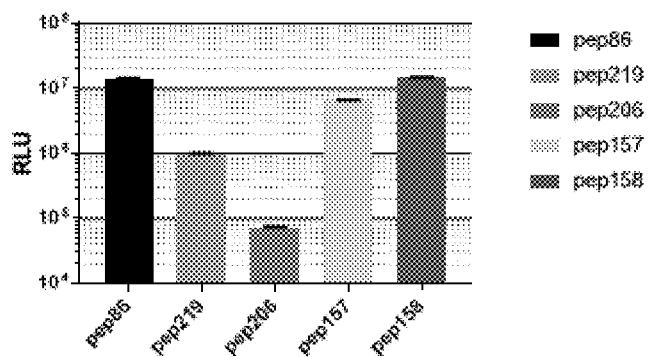

Experiments were conducted during development of embodiments herein to determine the effect of C-terminal additions/deletions and/or corresponding additions/deletions to peptide tags on complementation and luminescence (FIG. 25). Exemplary tested peptides and polypeptides are listed in Table 6.

TABLE 6

Peptide tags and polypeptide components comprising additions/deletions

SmTrip9
LITPDGSMLFRVTINSVSGWRLFKKIS
sequence at their N-termini.

Note: SmTrip9 peptides contain additional SSWKR

| LgTrip | C-term | SmTrip9 | ID | SmTrip10 | ID |
|---|---|---|---|---|---|
| ATG-3575 (aka LgTrip + GS) | --LITPDGS | MLFRVTINS | 292 | VSGWRLFKKIS | 86 |
| ATG-3572 (aka LgTrip + G) | --LITPDG | SMLFRVTINS | 291 | VSGWRLFKKIS | 86 |
| ATG-3573 (aka LgTrip − D) | --LITP | DGSML FRVTINS | 293 | VSGWRLFKKIS | 86 |
| ATG-3574 (aka LgTrip − PD) | --LIT | PDGSMLFRVTINS | 294 | VSGWRLFKKIS | 86 |
| ATG-3575 (aka LgTrip + GS) | --LITPDGS | MLFRVTINSV | 297 | SGWRLFKKIS | 219 |
| ATG-3572 (aka LgTrip + G) | --LITPDG | SMLFRVTINSV | 296 | SGWRLFKKIS | 219 |
| ATG-3573 (aka LgTrip − D) | --LITP | DGSMLFRVTINSV | 298 | SGWRLFKKIS | 219 |
| ATG-3574 (aka LgTrip − PD) | --LIT | PDGSMLFRVTINSV | 299 | SGWRLFKKIS | 219 |
| ATG-3575 (aka LgTrip + GS) | --LITPDGS | MLFRVTINSVS | 302 | GWRLFKKIS | 206 |
| ATG-3572 (aka LgTrip + G) | --LITPDG | SMLFRVTINSVS | 301 | GWRLFKKIS | 206 |
| ATG-3573 (aka LgTrip − D) | --LITP | DGSMLFRVTINSVS | 303 | GWRLFKKIS | 206 |
| ATG-3574 (aka LgTrip − PD) | --LIT | PDGSMLFRVTINSVS | 304 | GWRLFKKIS | 206 |
| ATG-3575 (aka LgTrip + GS) | --LITPDGS | MLFRVTIN | 308 | SVSGWRLFKKIS | 157 |
| ATG-3572 (aka LgTrip + G) | --LITPDG | SMLFRVTIN | 307 | SVSGWRLFKKIS | 157 |
| ATG-3573 (aka LgTrip − D) | --LITP | DGSMLFRVTIN | 309 | SVSGWRLFKKIS | 157 |
| ATG-3574 (aka LgTrip − PD) | --LIT | PDGSMLFRVTIN | 310 | SVSGWRLFKKIS | 157 |
| ATG-3575 (aka LgTrip + GS) | --LITPDGS | MLFRVTI | 312 | NSVSGWRLFKKIS | 158 |
| ATG-3572 (aka LgTrip + G) | --LITPDG | SMLFRVTI | 311 | NSVSGWRLFKKIS | 158 |
| ATG-3573 (aka LgTrip − D) | --LITP | DGSMLFRVTI | 313 | NSVSGWRLFKKIS | 158 |
| ATG-3574 (aka LgTrip − PD) | --LIT | PDGSMLFRVTI | 314 | NSVSGWRLFKKIS | 158 |
| ATG-3546 (aka LgTrip) | --LITPD | GSMLFRVTINSV | 295 | SGWRLFKKIS | 219 |

TABLE 6-continued

Peptide tags and polypeptide components comprising additions/deletions

SmTrip9 LITPDGSMLFRVTINSVSGWRLFKKIS
SmTrip10
Note: SmTrip9 peptides contain additional SSWKR sequence at their N-termini.

| LgTrip | C-term | SmTrip9 | ID | SmTrip10 | ID |
|---|---|---|---|---|---|
| ATG-3546 (aka LgTrip) | --LITPD | GSMLFRVTINSVS | 300 | GWRLFKKIS | 206 |
| ATG-3546 (aka LgTrip) | --LITPD | GSMLFRVTIN | 305 | SVSGWRLFKKIS | 157 |
| ATG-3546 (aka LgTrip) | --LITPD | GSMLFRVTI | 306 | NSVSGWRLFKKIS | 158 |

Addition/deletion polypeptides were grown in 50 ml cultures, pelleted, and resuspended in 10 ml of 100 mm HEPES pH 7.5+0.001U/ml DNase. 1 ml of Fastbreak Cell Lysis Reagent (Promega Corporation) and 1 ml of HisLink Resin (Promega Corporation) were added and incubated on a rotating shaker for 3 hours at 4° C. Resin was allowed to settle, and samples were washed 4x with 100 mM HEPES pH 7.5+10 mM Imidazole. Polypeptides were eluted twice into 500 ul HisLink Elution buffer. Thermo dialysis tubes were used to equilibrate to 1x TBS.

Enzymes were diluted to 200 nM in TBS+0.01% BSA+ 0.01% Tergitol, and serial dilutions were prepared (100 ul into 900 ul) in TBS+0.01% BSA+0.01% Tergitol. 2 nM samples were diluted 1:10 into TBS+0.01% BSA+0.01% Tergitol (500 ul into 4.5 ml). SmTrip9- and SmTrip10-like peptides were combined with a polypeptide complement according to Table 7 and incubated for 10 minutes at room temperature. 100 ul of TBS+0.01% BSA+0.01% Tergitol+ 20 uM furimazine was added, incubated for 10 minutes, and then read on GMM+.

TABLE 7

Polypeptide/peptide combinations tested.

| | Sm Trip 9 | Sm Trip10 |
|---|---|---|
| Group 1 | | |
| 3546 | 286 | 86 |
| 3575 | 292 | 86 |
| 3572 | 291 | 86 |
| 3573 | 293 | 86 |
| 3574 | 294 | 86 |
| Group 2 | | |
| 3546 | 286 | 86 |
| 3575 | 297 | 219 |
| 3572 | 296 | 219 |
| 3573 | 298 | 219 |
| 3574 | 299 | 219 |
| Group 3 | | |
| 3546 | 286 | 86 |
| 3575 | 302 | 206 |
| 3572 | 302 | 206 |
| 3573 | 302 | 206 |
| 3574 | 302 | 206 |
| Group 4 | | |
| 3546 | 286 | 86 |
| 3575 | 312 | 158 |
| 3572 | 312 | 158 |
| 3573 | 312 | 158 |
| 3574 | 312 | 158 |
| Group 5 | | |
| 3546 | 286 | 86 |
| 3575 | 295 | 219 |
| 3572 | 300 | 206 |
| 3573 | 305 | 157 |
| 3574 | 306 | 158 |

Example 30

Polypeptide/Peptide and/or Peptide/Peptide Overlap

Figure 26A:
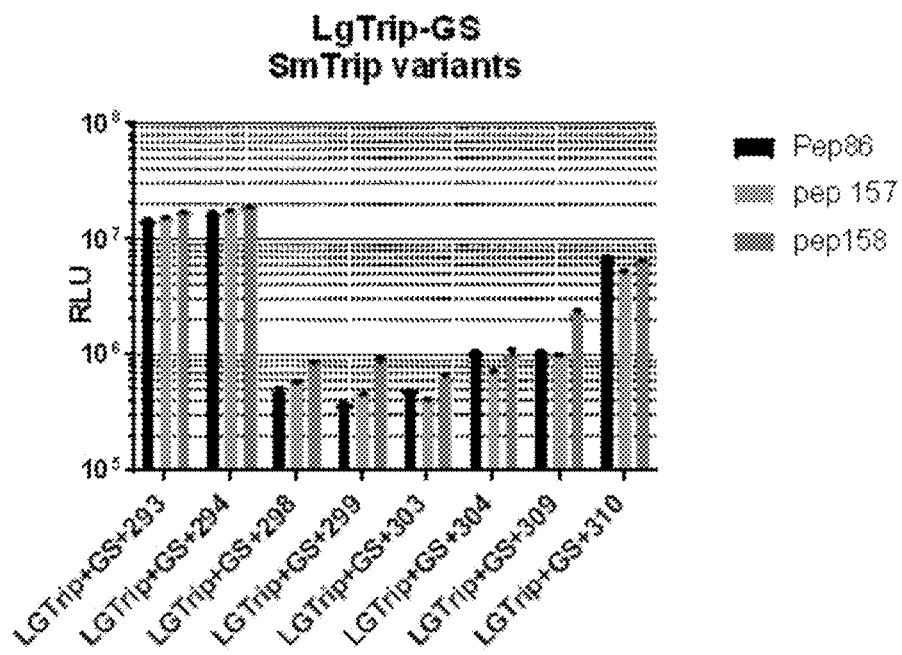
FIG. 26A-C. (A-C) Graphs depicting luminescence produced by polypeptide/peptide combinations having overlap (relative to a base luciferase sequence) between the polypeptide component and a peptide corresponding to the β9-strand or between the β9 and β10-like peptides.
Figure 26B:
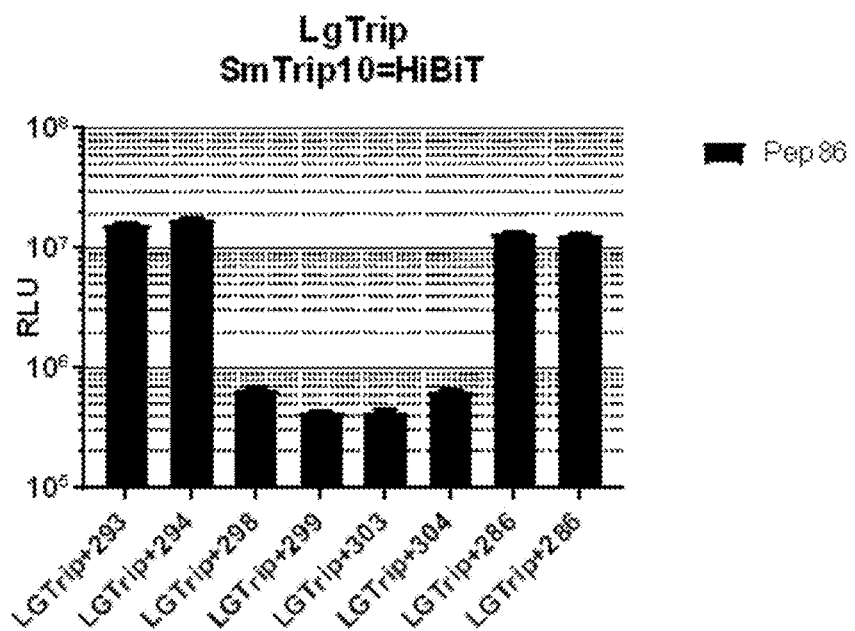
Figure 26C:
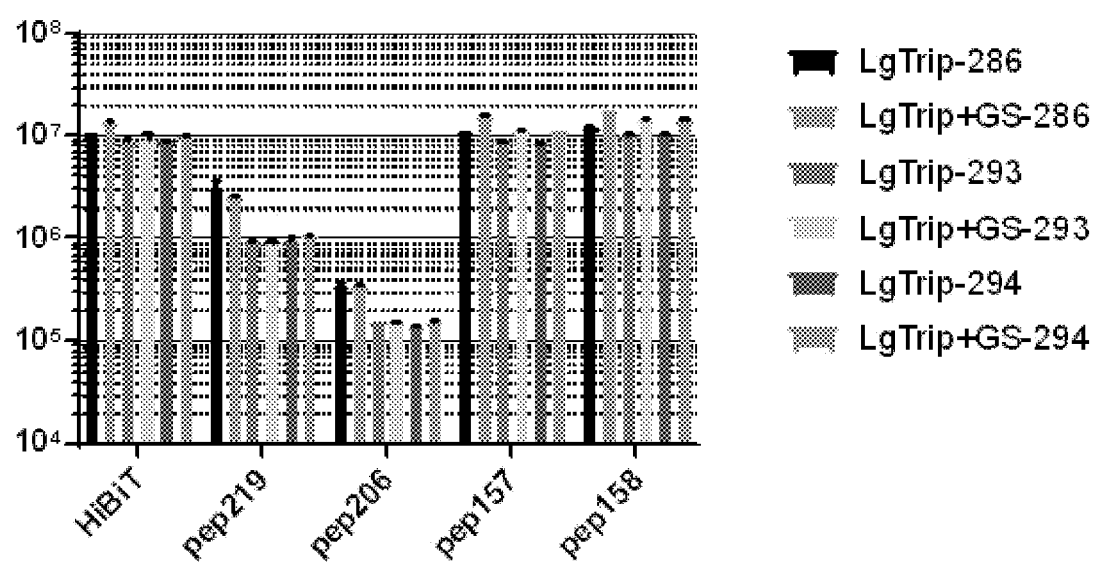

Experiments were conducted during development of embodiments herein to determine the sequence overlap between the polypeptide component and a peptide corresponding to the j-strand or between the two peptides (FIG. 26). In such experiments, a polypeptide component and peptide, or the two peptides, each comprise amino acids corresponding to the same amino acids in a base luciferase.

Polypeptides were diluted to 200 nM in TBS+0.01% BSA+0.01% Tergitol. Serial dilutions (100 ul into 900 ul) were prepared in TBS+0.01% BSA+0.01% Tergitol. 2 nM of each polypeptide sample were diluted 1:10 into TBS+0.01% BSA+0.01% Tergitol (500 into 4.5 ml). Polypeptides and peptides were combined, i.e., 50 ul of each LgTrip mutant with 50 ul of the peptide, according to Table 8. Reactions were incubated for 10 minutes at room temperature. Next, 100 ul of TBS+0.01% BSA+0.01% Tergitol+20 uM furimazine was added, and reactions were incubated for 10 more minutes prior to reading on a GMM+luminometer.

TABLE 8

Polypeptide/peptide combinations tested.

| | Sm Trip 9 | Sm Trip10 |
|---|---|---|
| Group 1 | | |
| 3546 | 286 | 86 |
| 3546 | 286 | 219 |
| 3546 | 286 | 206 |
| 3546 | 286 | 157 |
| 3546 | 286 | 158 |
| Group 2 | | |
| 3575 | 286 | 86 |
| 3575 | 286 | 219 |
| 3575 | 286 | 206 |
| 3575 | 286 | 157 |
| 3575 | 286 | 158 |
| Group 3 | | |
| 3546 | 293 | 86 |
| 3546 | 293 | 219 |
| 3546 | 293 | 206 |
| 3546 | 293 | 157 |
| 3546 | 293 | 158 |

TABLE 8-continued

Polypeptide/peptide combinations tested.

| | Sm Trip 9 | Sm Trip10 |
|---|---|---|
| Group 4 | | |
| 3575 | 293 | 86 |
| 3575 | 293 | 86 |
| 3575 | 293 | 86 |
| 3575 | 293 | 86 |
| 3575 | 293 | 86 |
| Group 5 | | |
| 3546 | 294 | 86 |
| 3546 | 294 | 219 |
| 3546 | 294 | 206 |
| 3546 | 294 | 157 |
| 3546 | 294 | 158 |
| Group 6 | | |
| 3575 | 294 | 86 |
| 3575 | 294 | 219 |
| 3575 | 294 | 206 |
| 3575 | 294 | 157 |
| 3575 | 294 | 158 |

Example 31

The Identity of the β9-Peptide Alters the Affinity of the β10-Peptide

Figure 27A:
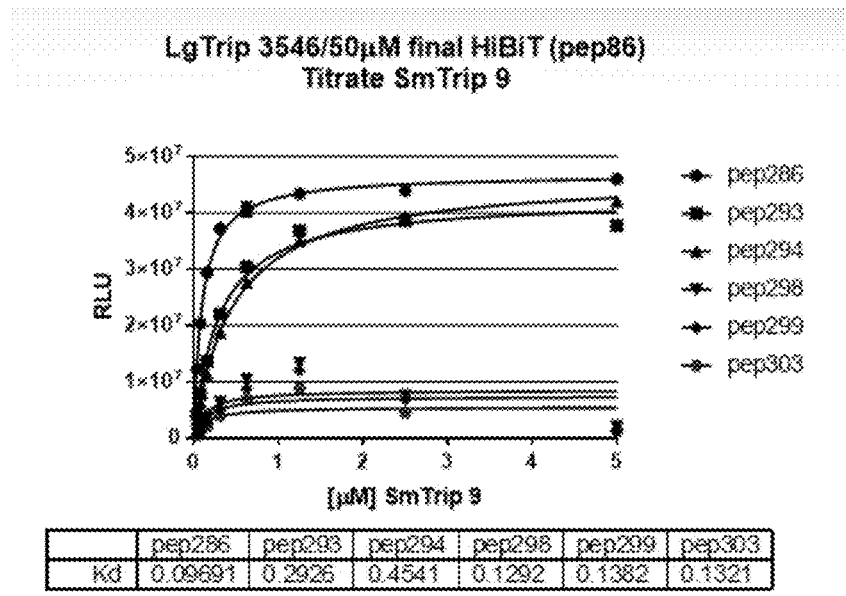
FIG. 27A-B. Figures and tables depicting luminescence resulting from (A) the titration of various β9-like peptides (SmTrip9 peptides) in the present of constant LgTrip 3546 (SEQ ID NO: 51) and SmTrip10 pep86 (SEQ ID NO: 25) concentrations, and (B) the titration of SmTrip10 pep86 (SEQ ID NO: 25) in the presence of constant concentrations of LgTrip 3546 (SEQ ID NO: 51) and various β9-like peptides (SmTrip9 peptides).
Figure 27B:
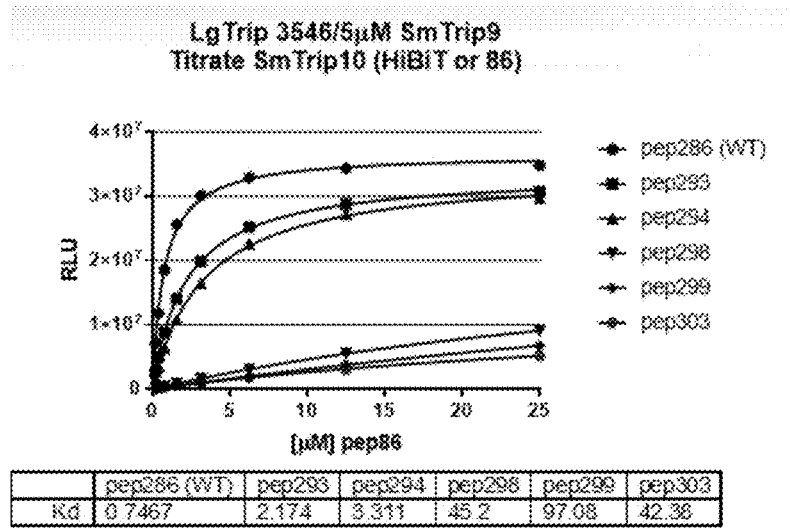

Experiments were conducted during development of embodiments herein to determine the sequence overlap between the polypeptide component and a peptide corresponding to the β-strand or between the two peptides (FIG. 27). These results show that the sequence of the β9 strand peptide (SmTrip9) can impact the affinity of the β10 strand peptide (SmTrip10).

SmTrip9 titration LgTrip 3546 (SEQ ID NO: 51) was diluted to 200 nM in TBS+0.01% BSA+0.01% Tergitol, and serial dilutions were prepared (100 ul into 900 ul) in TBS+0.01% BSA+0.01% Tergitol. 2 nM polypeptide samples were diluted 1:10 into TBS+0.01% BSA+0.01% Tergitol (500into 4.5 ml).

A 2× dilution series was prepared of each SmTrip9 peptide in TBS+0.01% BSA+0.01% Tergitol+100 uM of SmTrip10 pep86 (SEQ ID NO: 25) starting at 20 uM. 50 ul of diluted LgTrip 3546 (SEQ ID NO: 51) was combined with 50 ul of each peptide titration.

Reactions were incubated for 10 minutes at room temperature. 100 ul of TBS+0.01% BSA+0.01% Tergitol+20 uM furimazine was added, the reaction was incubated for 10 more minutes, and read on a GMM+.
SmTrip10 Titration LgTrip 3546 (SEQ ID NO: 51) was diluted to 200 nM in TBS+0.01% BSA+0.01% Tergitol, and serial dilutions were prepared (100 ul into 900 ul) in TBS+0.01% BSA+0.01% Tergitol. 2 nM polypeptide samples were diluted 1:10 into TBS+0.01% BSA+0.01% Tergitol (500into 4.5 ml).

A 2× dilution series was prepared of SmTrip10 pep86 (SEQ ID NO: 25) in TBS+0.01% BSA+0.01% Tergitol+20 uM of SmTrip9-like peptides starting at 100 uM. 50 ul of diluted LgTrip 3546 was combined with 50 ul of each peptide titration. Reactions were incubated for 10 minutes at room temperature. 100 ul of TBS+0.01% BSA+0.01% Tergitol+20 uM furimazine was added, reaction was incubated for 10 more minutes, and then read on GMM+.

Results (FIG. 27) SmTrip 9 peptide variants were titrated in the presence of constant SmTrip10 ep86 (SEQ ID 15) (FIG. 27a), and then SmTrip10 pep86 was titrated in the presence of saturating amounts of each SmTrip9 variant peptide. (FIG. 27b) This shows that the affinity of the SmTrip10 sequence can be altered depending on the SmTrip9 sequence. The experiments demonstrate that identity of the β9-like peptide (e.g., SmTrip9) can influence the affinity of the β10-like peptide (e.g., SmTrip10) for the polypeptide component. SmTrip9 pep293 (SEQ ID NO: 154) and SmTrip9 pep294 (SEQ ID NO: 155) sequences have overlap with the C-terminus of LgTrip 3546 (SEQ ID NO: 51) and show a decrease in affinity compared to SmTrip9 pep286 (SEQ ID NO: 37) (no overlap), but also decrease affinity of SmTrip10 pep86 (SmHiTrip; SEQ ID NO: 25) for LgTrip 3546. SmTrip9 pep298 (SEQ ID NO: 158) and SmTrip9 pep299 (SEQ ID NO: 159) sequences overlap with the C-terminus of LgTrip 3546 and the N-terminus of SmTrip10 pep86 (SmHiTrip; SEQ ID NO: 25) and decrease the affinity of SmTrip10 pep86 (HiBiT) for or LgTrip 3546.

Example 32

Effect of β10-Peptide Identity on the Affinity of the β10 Peptide Component to the Polypeptide and β9-Peptide.

Figure 28:
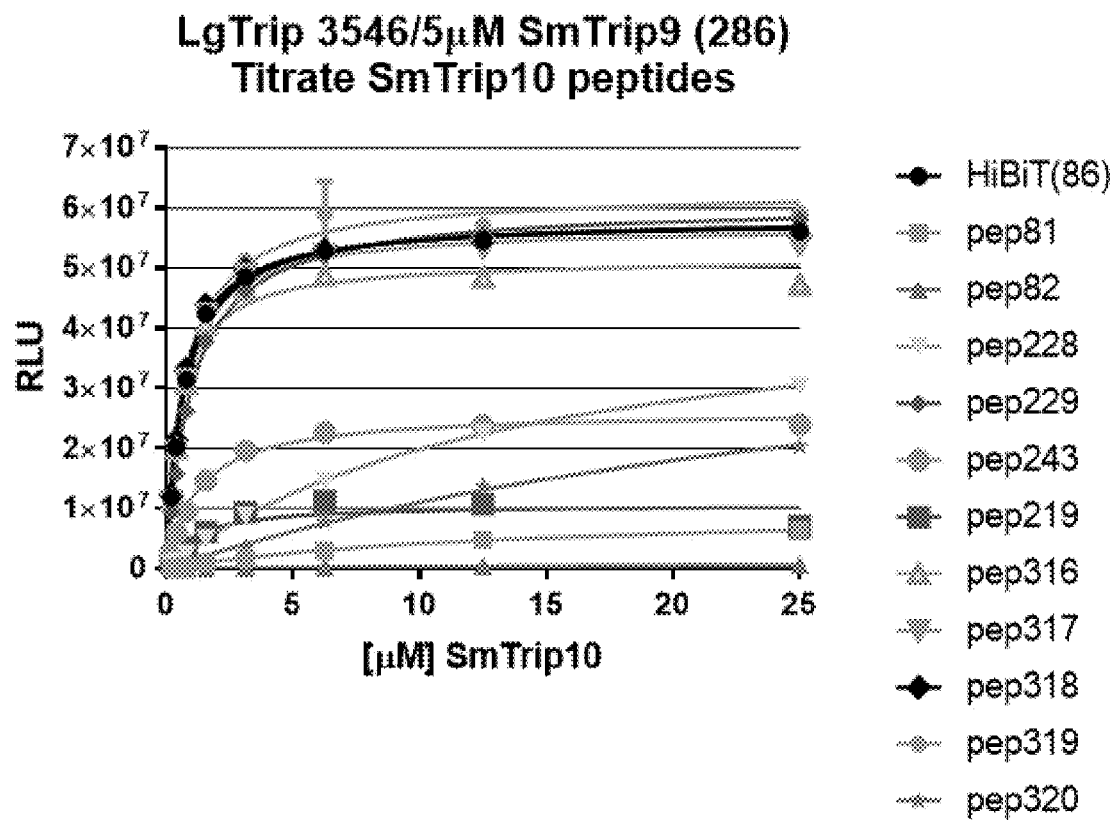
FIG. 28. Figure and table depicting luminescence resulting from the titration of various β10-like peptides (SmTrip 10 peptides) in the present of constant concentrations of LgTrip 3546 (SEQ ID NO: 51) and SmTrip9 pep286 (SEQ ID NO: 37).

Experiments were conducted during development of embodiments herein to determine the how sequence overlaps or sequence gaps between the polypeptide component and a peptide corresponding to the β-strands or between the two peptides influence the affinity of the β10-like (e.g., SmTrip10) peptides (FIG. 28). LgTrip 3546 (SEQ ID NO: 51) was diluted to 200 nM in TBS+0.01% BSA+0.01% Tergitol, and serial dilutions were prepared (100 ul into 900 ul) in TBS+0.01% BSA+0.01% Tergitol. 2 nM polypeptide samples were diluted 1:10 into TBS+0.01% BSA+0.01% Tergitol (500 into 4.5 ml). A 2× dilution series was prepared of each SmTrip10-like peptide in TBS+0.01% BSA+0.01% Tergitol+20 uM of SmTrip9 pep286 (SEQ ID NO: 37) starting at 100 uM. 50 ul of diluted LgTrip 3546 was combined with 50 ul of each peptide titration. Reactions were incubated for 10 minutes at room temperature. 100 ul of TBS+0.01% BSA+0.01% Tergitol+20 uM furimazine was added, reaction was incubated for 10 more minutes, and then read on GMM+.

Example 33

Figure 29A:
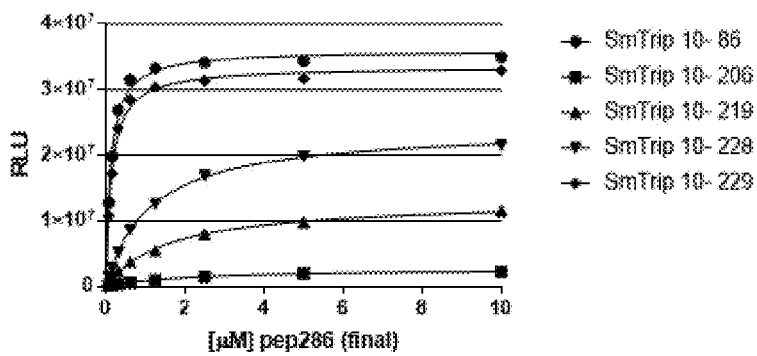
FIG. 29A-B. Figures and tables depicting titration of β9-like peptides (A) SmTrip9 pep286 (SEQ. ID 37) and (B) SmTrip9 pep287 (SEQ ID NO: 148) in the presence of constant concentration of various β10-like peptides (SmTrip10 peptides) and LgTrip 3546 (SEQ ID NO: 51) polypeptide component.
Figure 29B:
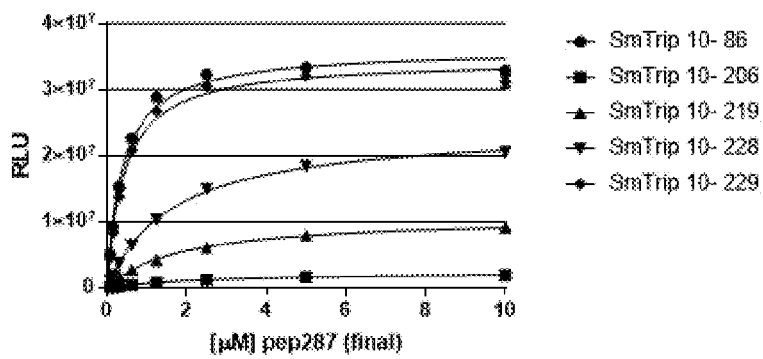

Measure of Affinity of β9-Like Peptides in the Presence of Various Saturating β10-Like Peptides Experiments were conducted during development of embodiments herein to determine the how the affinity of β9-like (e.g., SmTrip9) peptides are impacted in the presence of constant concentrations of various β10-like (e.g., SmTrip10) peptides with LgTrip 3546 (SEQ ID NO: 51) (FIG. 29). Polypeptide component LgTrip 3546 was diluted to 200 nM in TBS+0.01% BSA+0.01% Tergitol, serial dilutions were prepared (100 ul into 900 ul) in TBS+0.01% BSA+0.01% Tergitol (2× to make 2 nM), and 2 nM sample was diluted 1:10 into TBS+0.01% BSA+0.01% Tergitol (500 μl into 4.5 ml). A 2× dilution series was prepared of each β9-like peptide (SmTrip9 pep286 (SEQ ID NO: 37) and SmTrip9 pep287 (SEQ ID NO: 148)) in TBS+0.01% BSA+0.01% Tergitol+100 uM of each SmTrip10-like peptide starting at 20 uM. 50 ul of diluted LgTrip 3546 (SEQ ID NO: 51) was combined with 50 ul of each peptide titration. The reactions were incubated for 10 minutes at room temperature, 100 ul of TBS+0.01% BSA+0.01% Tergitol+20 uM furimazine was added, and the reactions were incubated for another 10 minutes and then read on GMM+.

Example 34

Effect of Construct Orientation on Facilitated Complementation in HEK293 Cells

Figure 30:
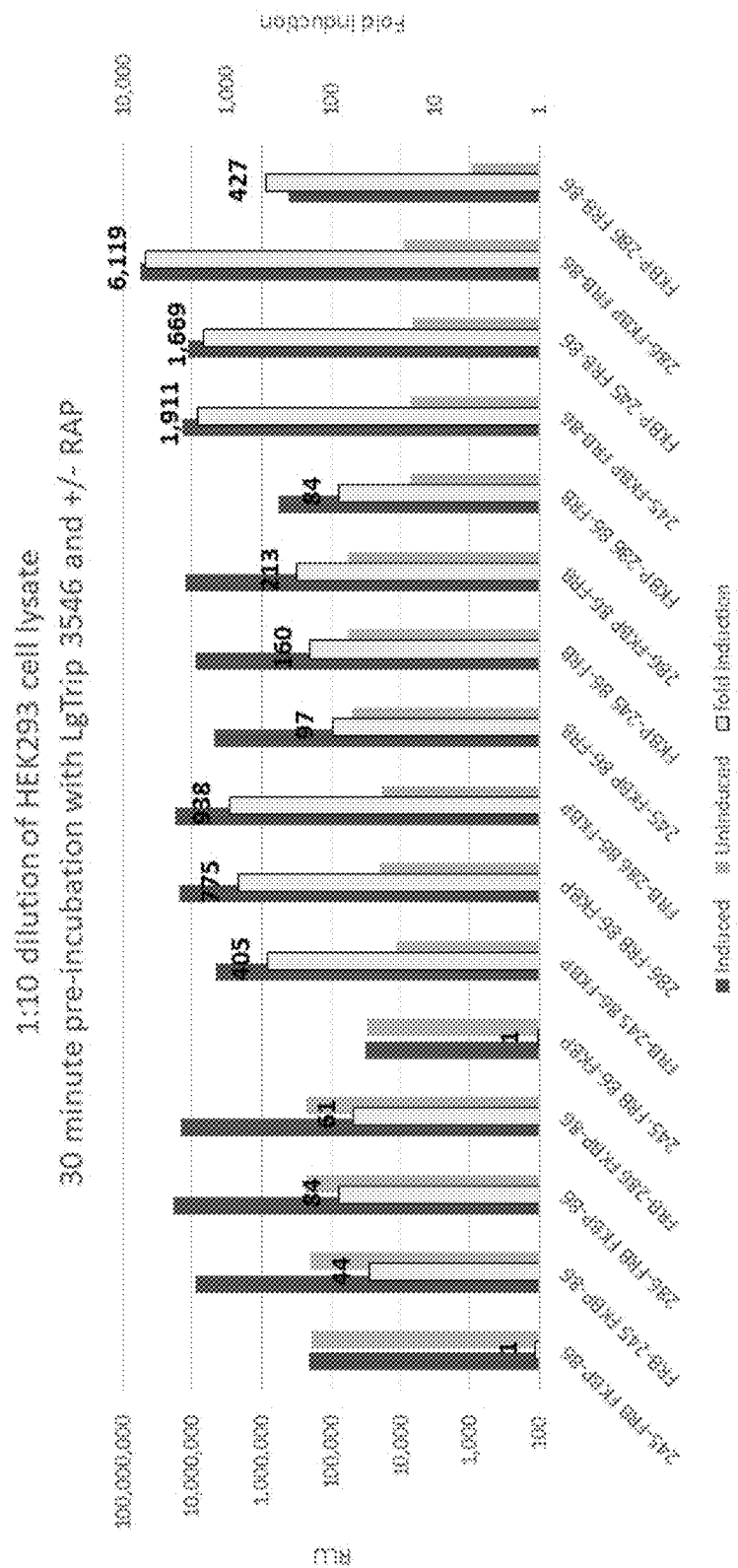
FIG. 30. Graph depicting the effect of construct orientation (β9-FKBP, FKBP-β9, β10-FKBP, FKBP-β10, β9-FRB, FRB-β9, β10-FRB, or FRB-β10) on facilitated complementation in HEK293 cells.

Experiments were conducted during development of embodiments herein to determine the effect the orientation of interaction elements (FRB and FKBP) relative to the peptide tags on complementation with LgTrip 3546 (SEQ ID NO: 51) (FIG. 30). Un-induced signal greater than 100,000 RLU is indicative of background contamination, which decreases the apparent fold-response.

HEK293 cells were grown overnight at 37° C. with 5% $CO_2$. Cells were transfected with 3 ug DNA (SmTrip9 pep245-FKBP, FKBP-SmTrip9 pep245, SmTrip10 pep86-FKBP, FKBP-SmTrip10 pep86, SmTrip9 pep245-FRB, FRB-SmTrip9 pep245, SmTrip10 pep86-FRB, or FRB-SmTrip10 pep86 construct) per well using FuGENE protocol. Cells were washed in DPBS. 1 ml DPBS was added, cells were frozen at −80C for ~10 min, and thawed at room temperature. Lysates were cleared by centrifugation for 10 minutes, diluted 1:10 in TBS+200 nM LgTrip (+/−30 nM RAP), and incubated for 30 min at room temperature. 50 ul of each sample was combined with 50 ul of TBS+20 uM Furimazine, and luminescence was read at 5 minutes.

Example 35

Effect of Construct Orientation on Facilitated Complementation in *E. coli*

Figure 31:
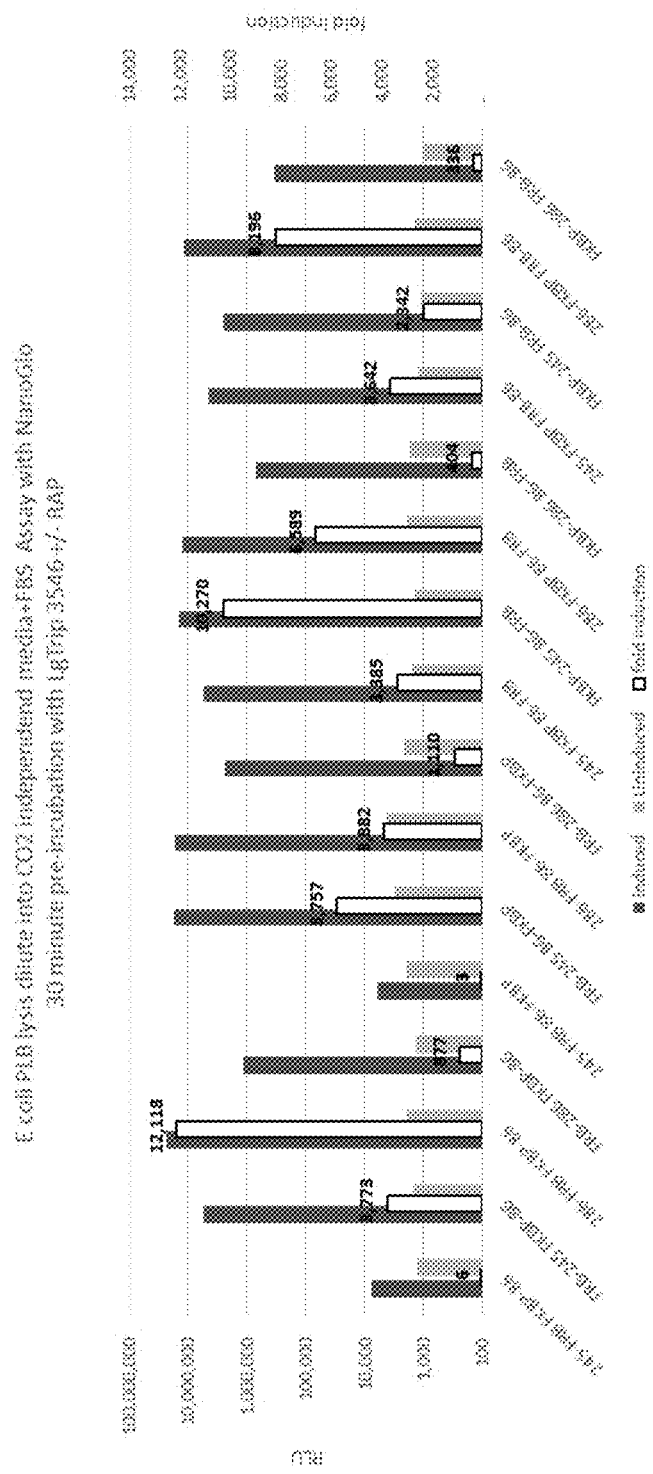
FIG. 31. Graph depicting the effect of construct orientation (β9-FKBP, FKBP-β9, β10-FKBP, FKBP-β10, β9-FRB, FRB-β9, β10-FRB, or FRB-β10) on facilitated complementation in E. coli cells.

Experiments were conducted during development of embodiments herein to determine the effect the orientation of interaction elements (FRB and FKBP) relative to the peptide tags on complementation with LgTrip 3546 (SEQ ID NO: 51) (FIG. 31).

Overnight cultures of each construct were prepared in LB+100 ug/ml ampicillin. Cultures were diluted 1:100 into induction media (LB+amp+0.1% rhamnose+0.15% glucose, cells were grown for 20 hours at 25° C., and lysed with PLB lysis buffer (0.3× PLB, 25 mM Hepes pH 7.5, 0.001U/ul Rq1 DNase; 250 ul of cells, 750 ul PLB) for 15 minutes. Cells were diluted 5× into $CO_2$ independent media+10% FBS that contains 200 nM LgTrip 3546 and +/−30 nM RAP. Reactions were incubated for 30 minutes at room temperature, combined with equal volumes of NanoGlo+50 uM furimazine (50 ul to 50 ul), incubated for 5 minutes, and then read on GMM+

Example 36

$K_d$ Measurement for Various β10-Like Peptides

Figure 32:
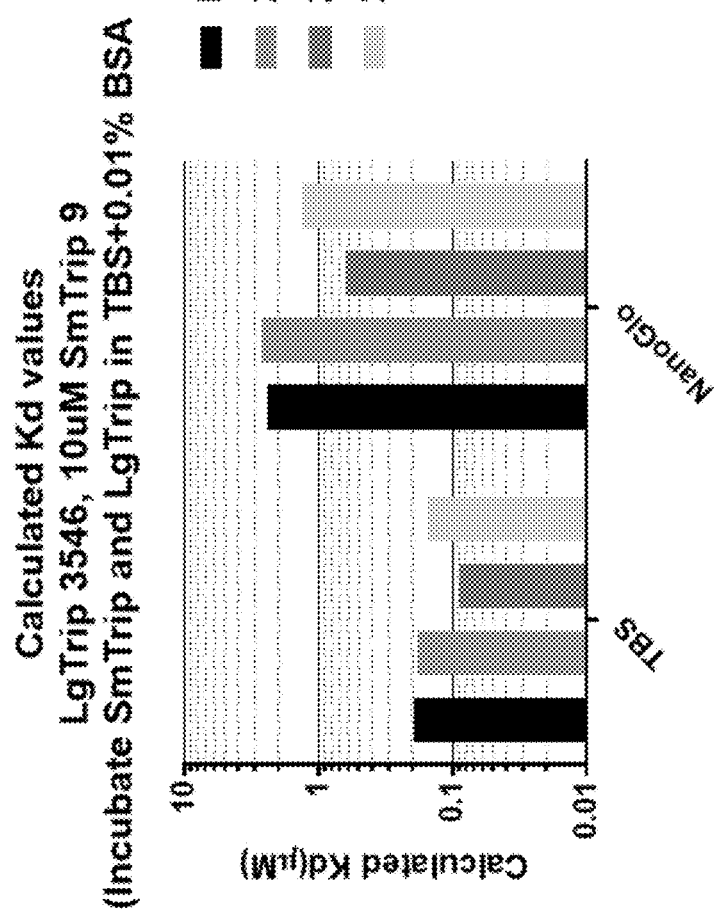
FIG. 32. Graph depicting calculated Kd values for various β10-like peptides with LgTrip 3546 (SEQ ID NO: 51) and SmTrip9 pep286 (SEQ ID NO: 37).

Experiments were conducted during development of embodiments herein to measure $K_d$ values for various β10-like peptides with LgTrip 3546 (SEQ ID NO: 51) and SmTrip9 pep286 (SEQ ID NO: 37) (FIG. 32). A solution was prepared of 20 uM SmTrip9 pep286 (SEQ ID NO: 37) in TBS+0.005%+0.01% BSA. 3× serial dilutions were prepared of SmTrip10 pep86 (SmHiTrip; SEQ ID NO: 25), SmTrip10 pep288 (SEQ ID NO: 149), SmTrip10 pep289 (SEQ ID NO: 150), and SmTrip10 pep290 (SEQ ID NO: 151) (150 ul in 350 ul TBS+0.01% BSA+286 solution starting at 100 uM). 20 nM LgTrip 3546 solutions were prepared in TBS+0.01% BSA, and then diluted 1:10 in TBS+0.01% BSA. 25 ul of each peptide solution was combined with 2.5 ul of the LgTrip 3546 solutions. Reactions were incubated for 10 minutes, 28 ul of TBS+20 uM LCS (Promega Catalog No. N205) was added, incubated for 10 minutes, and then read on GMM+. This experiment shows that the addition of either "V" or "VS" to the N-terminus of SEQ ID NO: 25 increases the affinity of the SmTrip10-like peptide compared to SmTrip10 pep86 (HiBiT).

Example 37

Effect of Polypeptide/P9 Split Site on Luciferase Light Output

Figure 33:
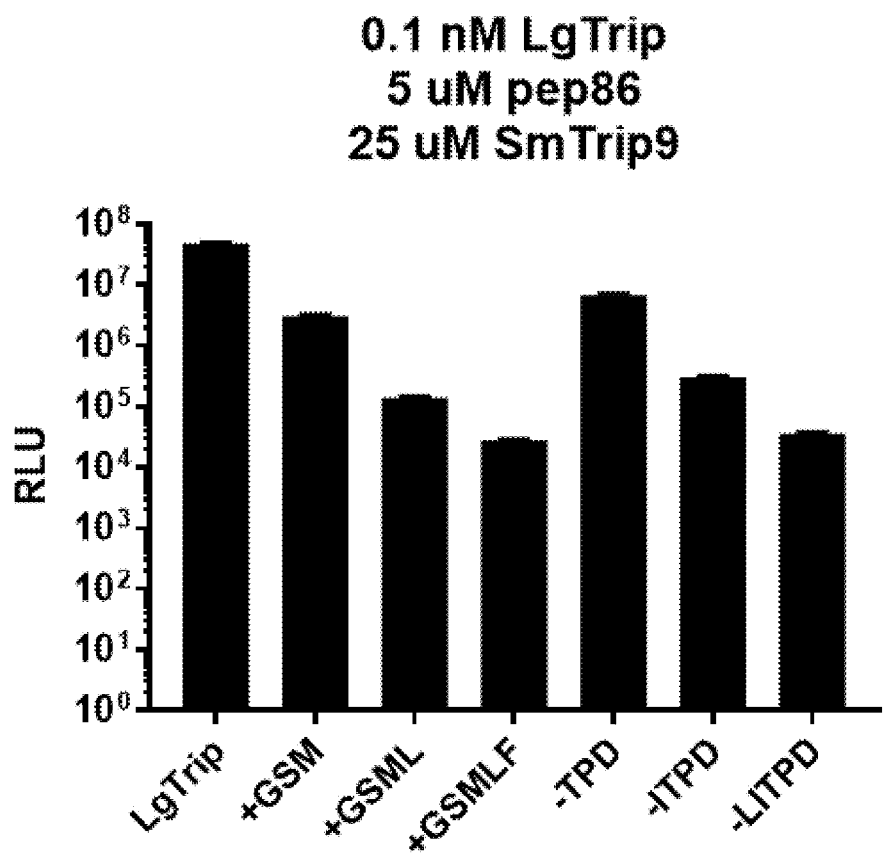
FIG. 33. Graph and table depicting luminescence from combinations of components having varied split sites between the polypeptide component LgTrip 3546 (SEQ ID NO: 51) and the β9-like peptide.

Experiments were conducted during development of embodiments herein to analyze the effect of moving the split site between the polypeptide component and the SmTrip9-like peptide (FIG. 33). Polypeptide components with varied C-terminal extensions or deletions were diluted to 0.2 nM in TBS+0.01% BSA+0.01% Tergitol, and 50 uM SmTrip10 pep86 (SEQ ID NO: 25) was added to each. SmTrip9 pep286 (SEQ ID NO: 37) was added to 10 uM in the SmTrip10 pep86+LgTrip solutions, and samples were incubated for 10 minutes. TBS+0.01% BSA+0.01% Tergitol+20 uM furimazine detection reagent was added at 1:1, and luminescence was read. All synthetic SmTrip9 peptides contained the N-terminal solubility tag SSWKR.

Example 38

Figure 34:
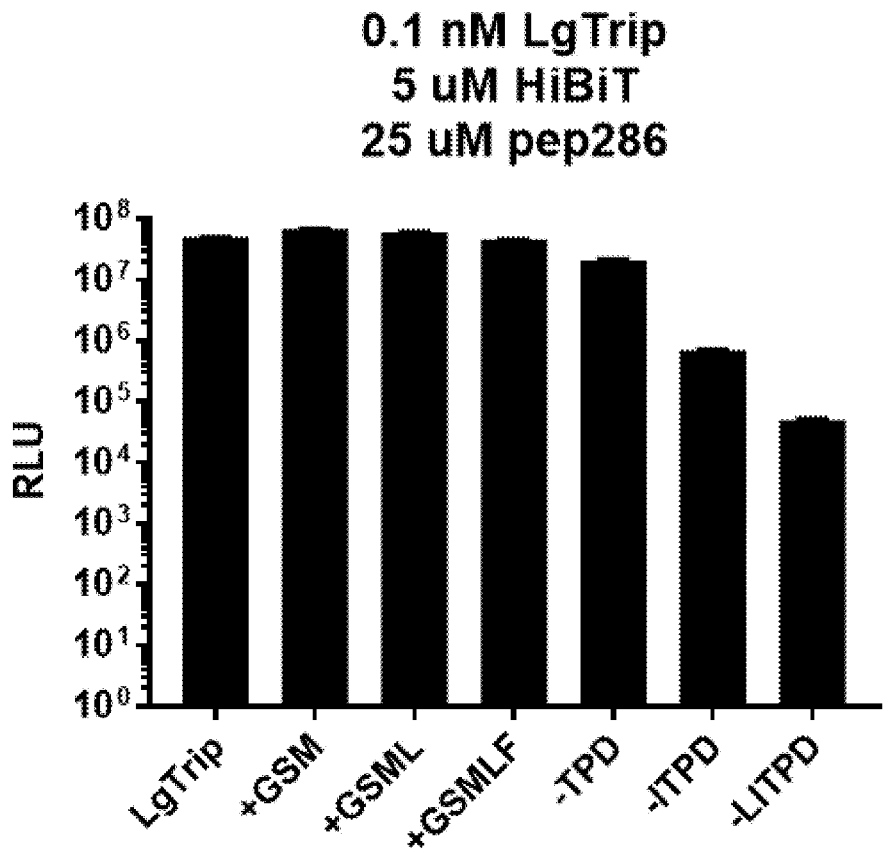
FIG. 34. Graph depicting luminescence from combinations of components with sequence gaps and/or overlaps between various LgTrip polypeptide components and SmTrip9 pep286 (SEQ ID NO: 37).

Effect of Sequence Gaps and Overlaps Between LgTrip C-Terminus and SmTrip9 Pep286 on Luciferase Light Output Experiments were conducted during development of embodiments herein to analyze the effect of gaps and/or overlaps between the polypeptide component and the SmTrip9-like peptide (FIG. 34). Polypeptide components with varied C-terminal extensions or deletions were diluted to 0.2 nM in TBS+0.01% BSA+0.01% Tergitol, and 50 uM SmTrip10 pep86 (SEQ ID NO: 25) was added to each. 10 uM of a SmTrip9 pep286 was added to SmTrip10 pep86+LgTrip solutions, and the reactions were incubated for 10 minutes. TBS+0.01% BSA+0.01% Tergitol+20 uM furimazine detection reagent was added at 1:1, and luminescence was read.

Example 39

Figure 35:
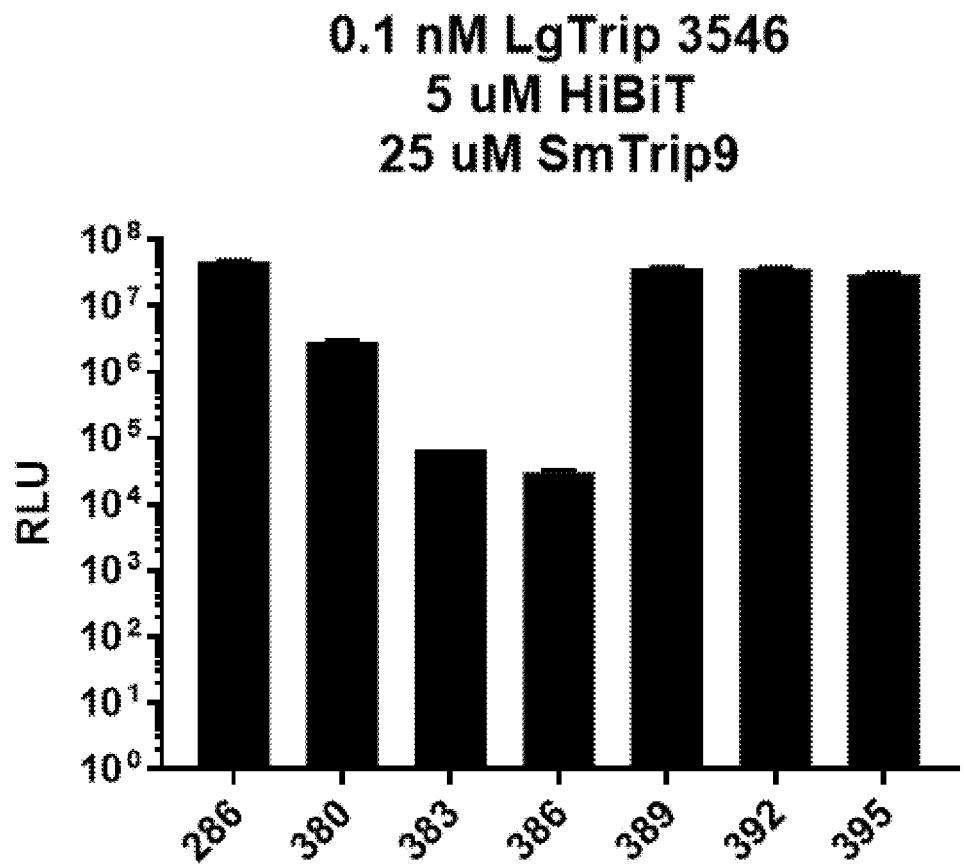
FIG. 35. Graph depicting luminescence from NanoTrip™ component combinations with gaps and/or overlaps in sequence between the β9-like peptides (SmTrip9 peptides) and polypeptide component LgTrip 3546 (SEQ ID NO: 51) in the presence of SmTrip10 pep86 (HiBiT; SEQ ID NO: 25).

Effect of SmTrip9 Sequence Gaps and Overlaps with LgTrip 3546 and SmTrip10 Pep 86 (HiBiT) on Luciferase Light Output Experiments were conducted during development of embodiments herein to analyze the effect of gaps and/or overlaps between the SmTrip9-like peptide and the polypeptide component (e.g., LgTrip) and/or SmTrip10-like peptide (FIG. 35). LgTrip 3546 (SEQ ID NO: 51) was diluted to 0.2 nM in TBS+0.01% BSA+0.01% Tergitol, and 50 uM SmTrip10 pep86 (SEQ ID NO: 25) was added to each. SmTrip9 pep286 (SEQ ID NO: 37) was added to 10 uM in SmTrip10 pep86+LgTrip solutions, and samples were incubated for 10 minutes.

TBS+0.01% BSA+0.01% Tergitol+20 uM furimazine detection reagent was added at 1:1, and luminescence was read. All synthetic SmTrip9 peptides contained the N-terminal solubility tag, SSWKR.

Example 40

Biochemical Analysis (Kd and Bmax) of SmTrip9 Peptide Length Variants

Experiments were conducted during development of embodiments herein to analyze complementation of SmTrip9 peptides of different lengths with LgTrip 3546 (SEQ ID NO: 51) and SmTrip10 pep86 (SmHiTrip; SEQ ID NO: 15) (FIGS. 36-37).

SmTrip9 titration (FIG. 36) LgTrip 3546 (SEQ ID NO: 51) polypeptide was diluted to 0.2 nM in TBS+0.01% BSA+0.01% Tergitol. 100 uM SmTrip10 pep86 was prepared in TBS+0.01% BSA+0.01% Tergitol. 20 uM solutions of each SmTrip9-like peptide were added to the SmTrip10 pep86 solution. 2× serial dilutions were prepared of each SmTrip9 peptide solution using the SmTrip10 pep86 solution as a diluent. Peptide dilutions and LgTrip 3546 solution were combined 1:1 and incubated for 10 minutes. TBS+0.01% BSA+0.01% Tergitol+20 uM furimazine detection reagent was added (1:1), and luminescence was detected.

HiBiT (SmTrip10) titration (FIG. 37) LgTrip 3546 (SEQ ID NO: 51) polypeptide was diluted to 0.2 nM in TBS+0.01% BSA+0.01% Tergitol. 20 uM SmTrip9-like peptide solutions were prepared in TBS+0.01% BSA+0.01% Tergitol for each SmTrip9-like peptide to be tested. 100 uM solutions of SmTrip10 pep86 was added to each SmTrip9-like peptide solution. 2× serial dilutions were prepared of SmTrip10 pep86 using each SmTrip9-like peptide solution as a diluent. Peptide dilutions and LgTrip 3546 solution were combined, 1:1, and incubated for 10 minutes. TBS+0.01% BSA+0.01% Tergitol+20 uM furimazine detection reagent was added (1:1), and luminescence was detected.

Example 41

Biochemical Affinity and Bmax of SmTrip9 Pep286 Point Mutants

Experiments were conducted during development of embodiments herein to analyze the affinity of SmTrip9 pep286 (SEQ ID NO: 37) point mutants for LgTrip 3546 (SEQ ID NO: 51) and SmTrip10 pep86 (SmHiTrip; SEQ ID NO: 25). LgTrip 3546 polypeptide was diluted to 0.2 nM in TBS+0.01% BSA+0.01% Tergitol. 100 uM SmTrip10 pep86 was prepared in TBS+0.01% BSA+0.01% Tergitol. 20 uM solutions of each SmTrip9-like peptide were added to the SmTrip10 pep86 solution. 2× serial dilutions were prepared of each SmTrip9-like peptide solution using the SmTrip10 pep86 solution as a diluent. Equal volumes of peptide dilutions and LgTrip solution were combined and incubated for 10 minutes. TBS+0.01% BSA+0.01% Tergitol+20 uM furimazine detection reagent was added (1:1, vol:vol), and luminescence was detected (FIG. 38) to determine Kd and Bmax of each SmTrip9-like peptide.

Example 42

Effect of SmTrip9 Solubility Tags on Biochemical Affinity and Bmax

Experiments were conducted during development of embodiments herein to analyze the affinity of SmTrip9-like peptides with alternative solubility tags (FIG. 39). LgTrip 3546 (SEQ ID NO: 51) was diluted to 0.2 nM in TBS+0.01% BSA+0.01% Tergitol. 100 uM SmTrip10/pep86 solution was prepared in TBS+0.01% BSA+0.01% Tergitol. 20 uM solutions were prepared of each SmTrip9-like peptide in the SmTrip10 pep86 solution. 2× serial dilutions were prepared of each SmTrip9-like peptide using the SmTrip10 pep86 solution as a diluent. Equal volumes of peptide dilutions were combined with the LgTrip 3546 solution, and reactions were incubated for 10 minutes. TBS+0.01% BSA+0.01% Tergitol+20 uM furimazine detection reagent was added 1:1 vol:vol to the reactions, and luminescence was read after 10 minutes of incubation.

Example 43

C-Terminal Extension Sequences

Experiments were conducted during development of embodiments herein to analyze the affinity of SmTrip9-like peptides with C-terminal sequence extensions (FIG. 40).

SmTrip9 peptide titration LgTrip 3546 (SEQ ID NO: 51) polypeptide was diluted to 0.2 nM in TBS+0.01% BSA+0.01% Tergitol. 100 uM SmTrip10 pep86 was prepared in TBS+0.01% BSA+0.01% Tergitol. 20 uM solutions of each SmTrip9-like peptide were added to the SmTrip10 pep86 solution. 2× serial dilutions were prepared of each SmTrip9-like peptide solution using the SmTrip10 pep86 solution as a diluent. Peptide dilutions and LgTrip 3546 solution were combined 1:1 and incubated for 10 minutes. TBS+0.01% BSA+0.01% Tergitol+20 uM furimazine detection reagent was added (1:1), and luminescence was detected.

SmTrip10 pep 86 (HiBiT) titration LgTrip 3546 (SEQ ID NO: 51) polypeptide was diluted to 0.2 nM in TBS+0.01% BSA+0.01% Tergitol. 20 uM SmTrip9-like peptide solutions were prepared in TBS+0.01% BSA+0.01% Tergitol for SmTrip9-like peptide to be tested. 100 uM solutions of SmTrip10 pep86 (SEQ ID NO: 25) was added each SmTrip9-like solution. 2× serial dilutions were prepared of SmTrip10 pep86 using each SmTrip9-like peptide solution as a diluent. Peptide dilutions and LgTrip 3546 solution were combined 1:1 and incubated for 10 minutes. TBS+0.01% BSA+0.01% Tergitol+20 uM furimazine detection reagent was added (1:1), and luminescence was detected.

Example 44

Figure 41:
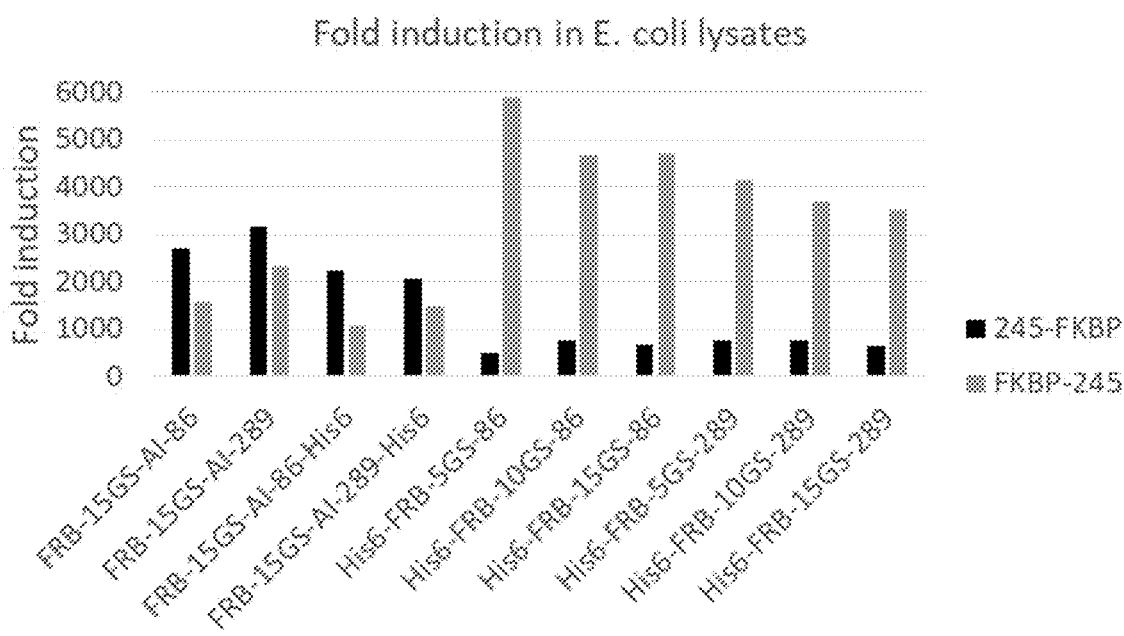
FIG. 41. Graph depicting the effect of FRB-β10 construct linker length (15, 10, or 5 Gly/Ser residues), linker composition (with or without Ala-Ile), hexahistidine tag inclusion, and β10 composition (SmTrip10 pep86 (SEQ ID NO: 25) or SmTrip10 pep289 (SEQ ID NO: 150)) on facilitated complementation in E. coli lysates with LgTrip 3546 (SEQ ID NO: 51).

Measurement of FRB-FKBP Facilitated Complementation Using FRB-SmTrip10 Variants and FKBP Fused SmTrip9 Pep245 in KRX *E. coli* Lysates Overnight cultures of FRB-SmTrip10 variants, FKBP-SmTrip9 pep245, and SmTrip9 pep245-FKBP were grown in LB+100 ug/ml ampicillin from glycerol stocks. Cells were diluted 1:100 in LB+0.15% glucose+0.1% rhamnose+Amp, and shook for 20 hours at 25° C. Cultures were diluted 1:4 in PLB and incubated 15 min at room temperature to lyse cells. SmTrip9/SmTrip10 peptide combinations were mixed 1:1 (vol:vol). Mixtures were diluted 1:5 into PLB+200 nM LgTrip 3546 (SEQ ID NO: 51) with or without 30 nM rapamycin, and reactions were incubated for 30 minutes at room temperature. Each reaction was combined with 50 ul of NanoGlo® buffer+50 uM Furimazine, and luminescence was measured at 5 minutes. Results for fold induction (+rap signal/−rap signal) are depicted in FIG. 41. FRB-SmTrip10 variant peptide constructs possessed varied linker lengths, linker content (with or without alanine-isoleucine), and either contained or lacked a hexahistidine tag.

Example 45

Figure 42:
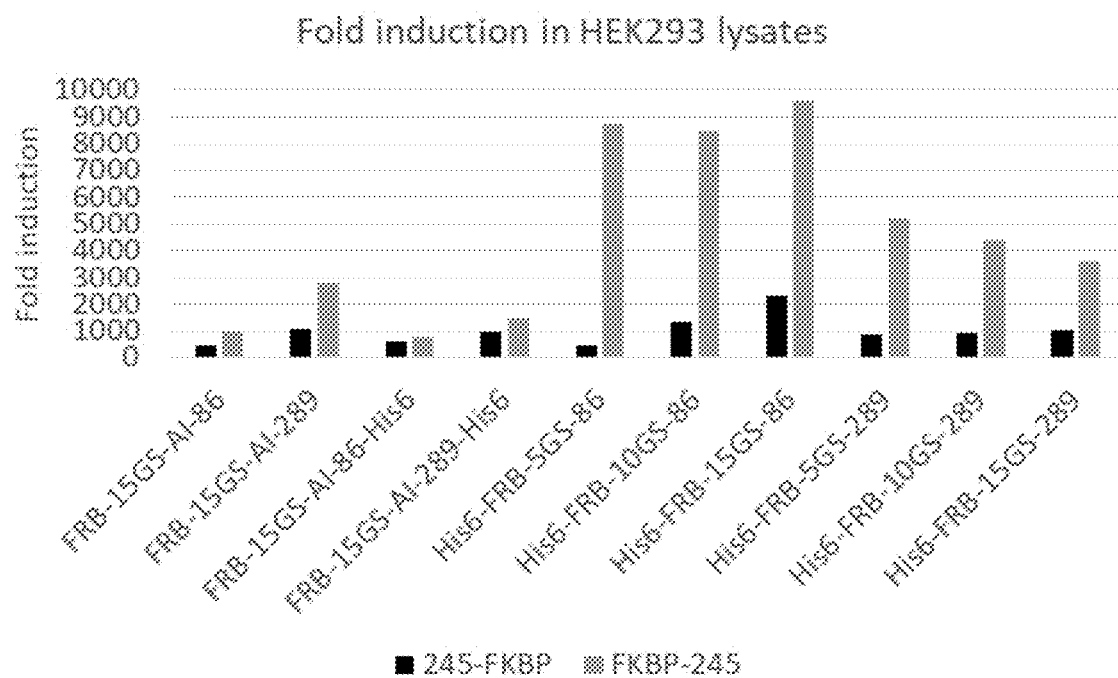
FIG. 42. Graph depicting the effect of FRB-β10 construct linker length (15, 10, or 5 Gly/Ser residues), linker composition (with or without Ala-Ile), hexahistidine tag inclusion, and β10 composition SmTrip10 pep86 (SEQ ID NO: 25) or SmTrip10 pep289 (SEQ ID NO: 150) on facilitated complementation in HEK lysates with LgTrip 3546 (SEQ ID NO: 51).
Figure 43:
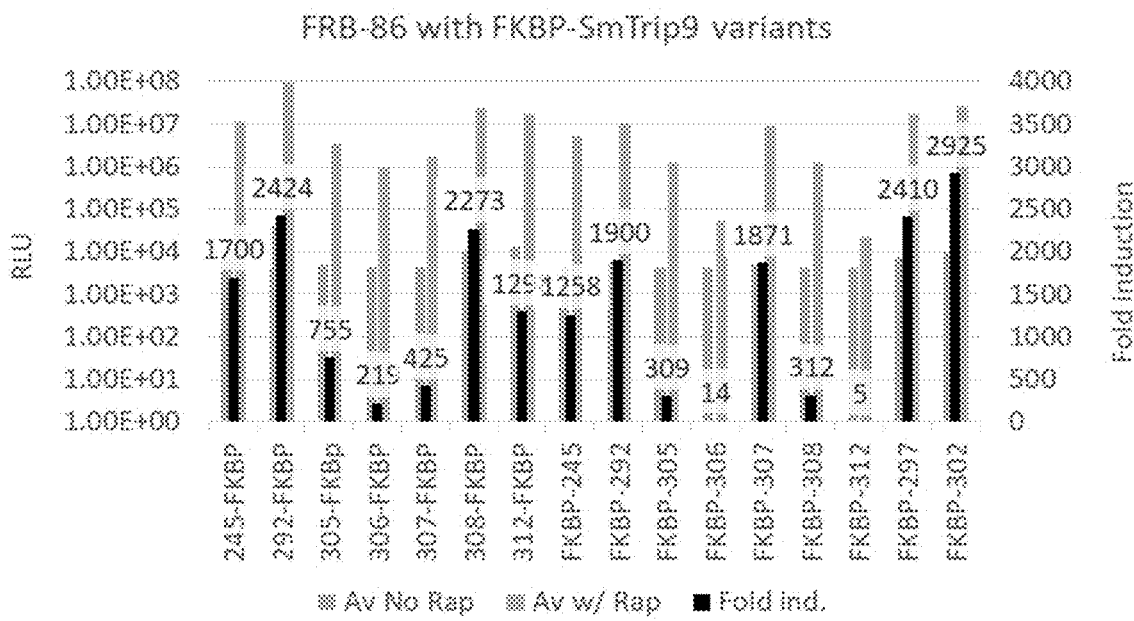
FIG. 43. Graph depicting the effect of β9 sequence truncations and extensions and construct orientation (β9-FKBP or FKBP-β9) on facilitated complementation with FRB-SmTrip10 pep86 (310) (SEQ ID NO: 25) in E. coli lysates with LgTrip 3546 (SEQ ID NO: 51).
Figure 44:
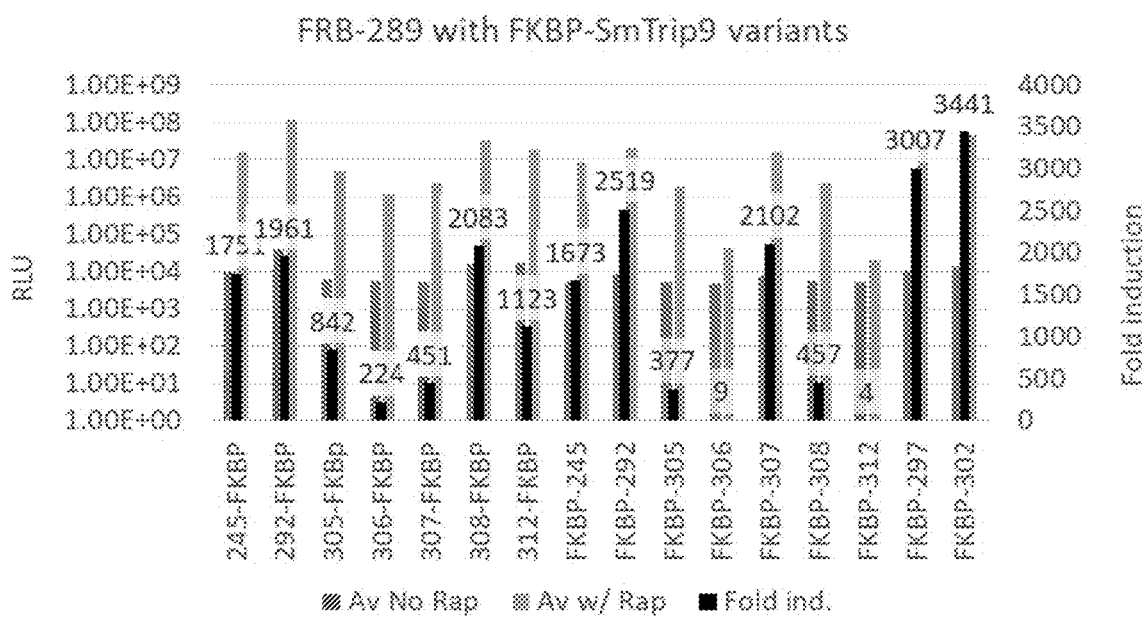
FIG. 44. Graph depicting the effect of β9 sequence truncations and extensions and construct orientation (β9-FKBP or FKBP-β9) on facilitated complementation with FRB-SmTrip10 pep289 (β10) (SEQ ID NO: 150) in E. coli lysates with LgTrip 3546 (SEQ ID NO: 51).
Figure 45:
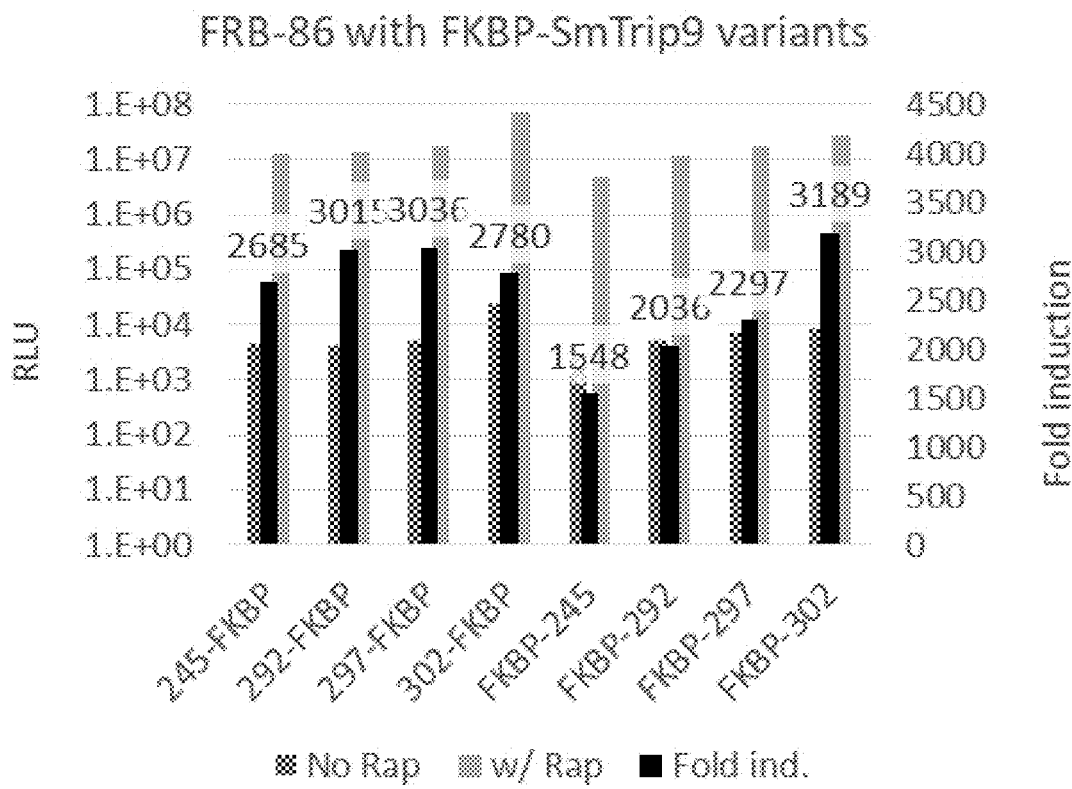
FIG. 45. Graph depicting the effect of β9 sequence truncations, extensions, and construct orientation (β9-FKBP or FKBP-β9) on facilitated complementation with FRB-SmTrip10 pep86 (β10) (SEQ ID NO: 25) in E. coli lysates with LgTrip 3546 (SEQ ID NO: 51).
Figure 46:
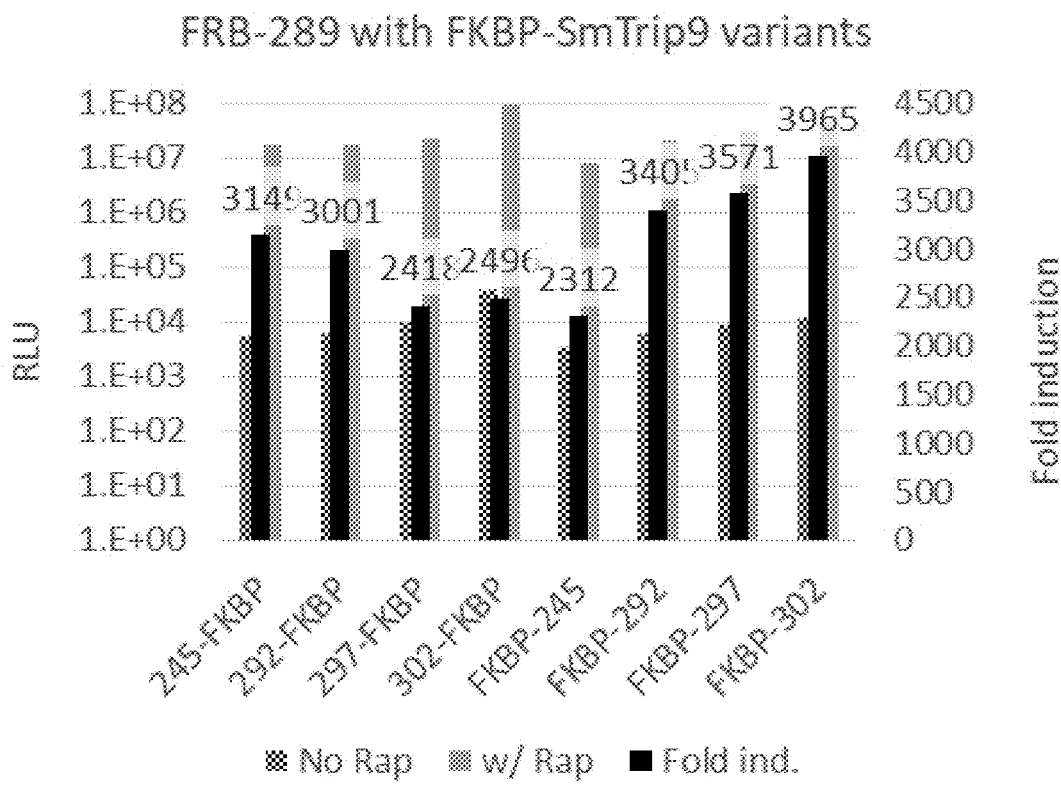
FIG. 46. Graph depicting the effect of β9 sequence truncations, extensions, and construct orientation (β9-FKBP or FKBP-β9) on facilitated complementation with FRB-SmTrip10 pep289 (β10) (SEQ ID NO 150) in E. coli lysates with LgTrip 3546 (SEQ ID NO: 51).
Figure 47:
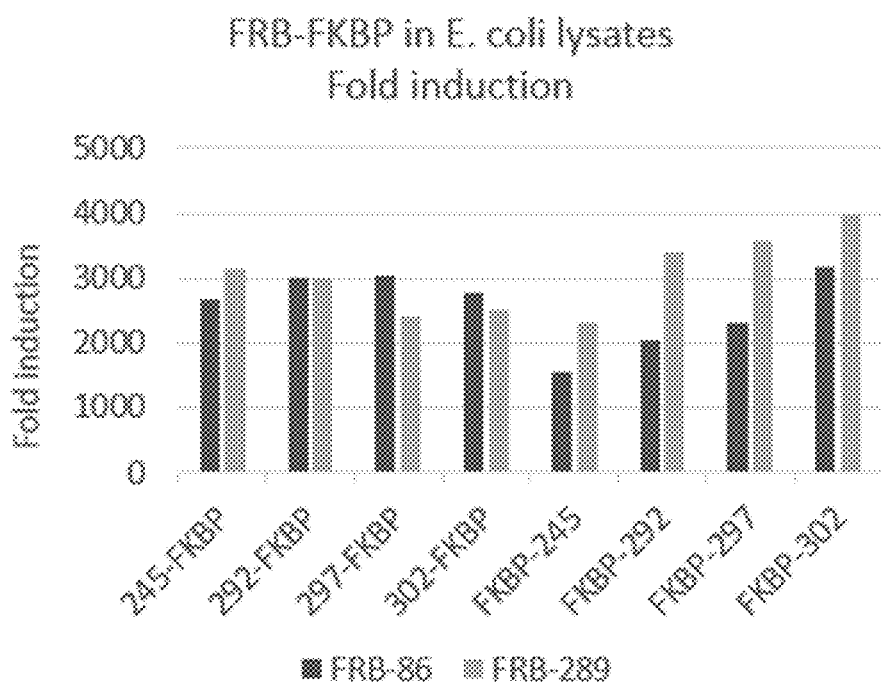
FIG. 47. Graph depicting the effect of β9 sequence truncations, extensions, and construct orientation (β9-FKBP or FKBP-β9) on fold induction (facilitated complementation/spontaneous complementation) with FRB-β10 (SmTrip10 pep86 (SEQ ID NO: 25) or SmTrip10 pep289 (SEQ ID NO: 150)) in E. coli lysates (Summary of FIGS. 45 and 46) with LgTrip 3546 (SEQ ID NO: 51).

Measurement of FRB-FKBP Facilitated Complementation Using FRB-SmTrip10 Variants and FKBP Fused SmTrip9 Pep245 in HEK Lysates Overnight cultures of FRB-SmTrip10 variants, FKBP-SmTrip9 pep245, and SmTrip9 pep245-FKBP were grown at 37° C. with 5% $CO_2$. Cells were transfected with 1 ug DNA (FKBP or FRB construct) per well using FuGENE protocol. Cells were washed in 1 ml DPBS. 1 ml DPBS was added and cultures were frozen at −80° C. for 10 min. Cultures were thawed at room temperature to lyse cells. Lysates were cleared by centrifugation for 10 min and diluted 2-fold in PLB. SmTrip9/SmTrip10 peptide combinations were mixed 1:1 (vol:vol). Mixtures were diluted 1:5 into PLB+200 nM LgTrip 3546 (SEQ ID NO: 51) with or without 30 nM rapamycin, and reactions were incubated for 30 minutes at room temperature. Each reaction was combined with 50 ul of NanoGlo® buffer+50 uM Furimazine, and luminescence was measured at 5 minutes. Results for fold induction (+rap signal/−rap signal) are depicted in FIG. 42. FRB-SmTrip10 variant peptide constructs possessed varied linker lengths, linker content (with or without alanine-isoleucine), and either contained or lacked a hexahistidine tag.

Example 46

Measurement of FRB-FKBP Facilitated Complementation Using FRB-SmTrip10 Pep86 (HiBiT)/SmTrip10 Pep289 (VS-HiBiT) and SmTrip9 Sequences Fused to FKBP in Both Orientations in KRX *E. coli* Lysates Overnight cultures for FRB-SmTrip10 pep86 (HiBiT; SEQ ID NO: 25) or FRB-SmTrip10 pep289 (VS-HiBiT; SEQ ID NO: 150) and SmTrip9-like peptide sequences fused to FKBP were grown in LB+100 ug/ml ampicillin from glycerol stocks. Cells were diluted 1:100 in LB+0.15% glucose+0.1% rhamnose+Amp and shaken for 20 hours at 25° C. Cultures were diluted 1:4 in PLB and incubated 15 min at room temperature to lyse.

SmTrip9/SmTrip10 peptide combinations were mixed 1:1 (vol:vol). Mixtures were diluted 1:5 into PLB+200 nM LgTrip 3546 (SEQ ID NO: 51) with or without 30 nM rapamycin, and reactions were incubated for 30 minutes at room temperature. Each reaction was combined with 50 ul of NanoGlo® buffer+50 uM Furimazine, and luminescence was measured at 5 minutes. Results are depicted in FIGS. 43-47.

Example 47

Figure 48:
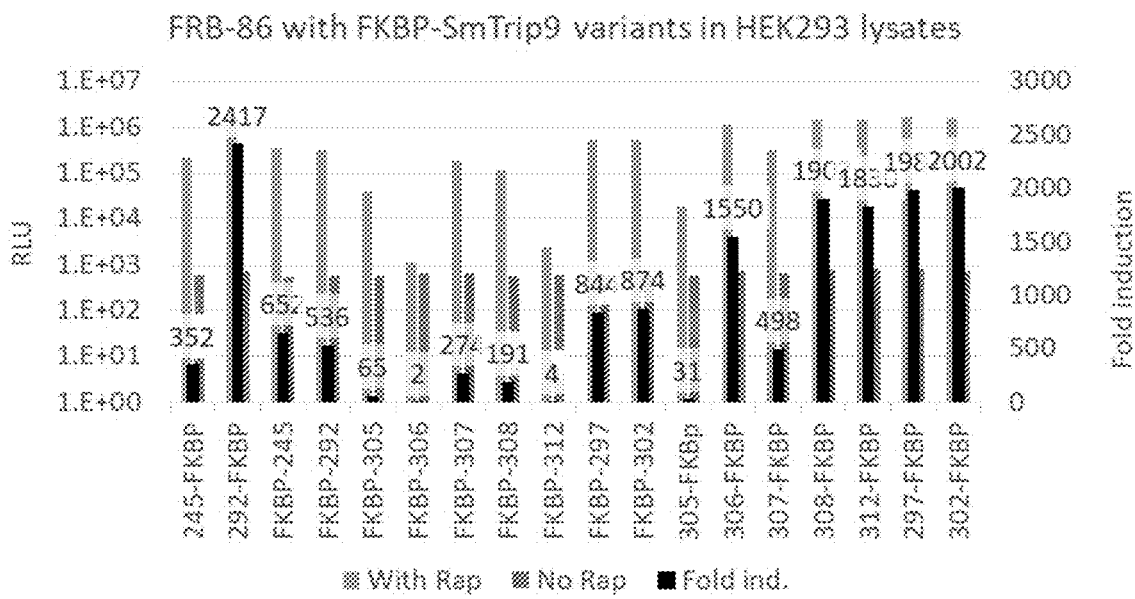
FIG. 48. Graph depicting the effect of β9 sequence truncations and extensions and construct orientation (β9-FKBP or FKBP-β9) on facilitated complementation with FRB-SmTrip10 pep86 (SEQ ID NO: 25) in HEK293 lysates with LgTrip 3546 (SEQ ID NO: 51).
Figure 49:
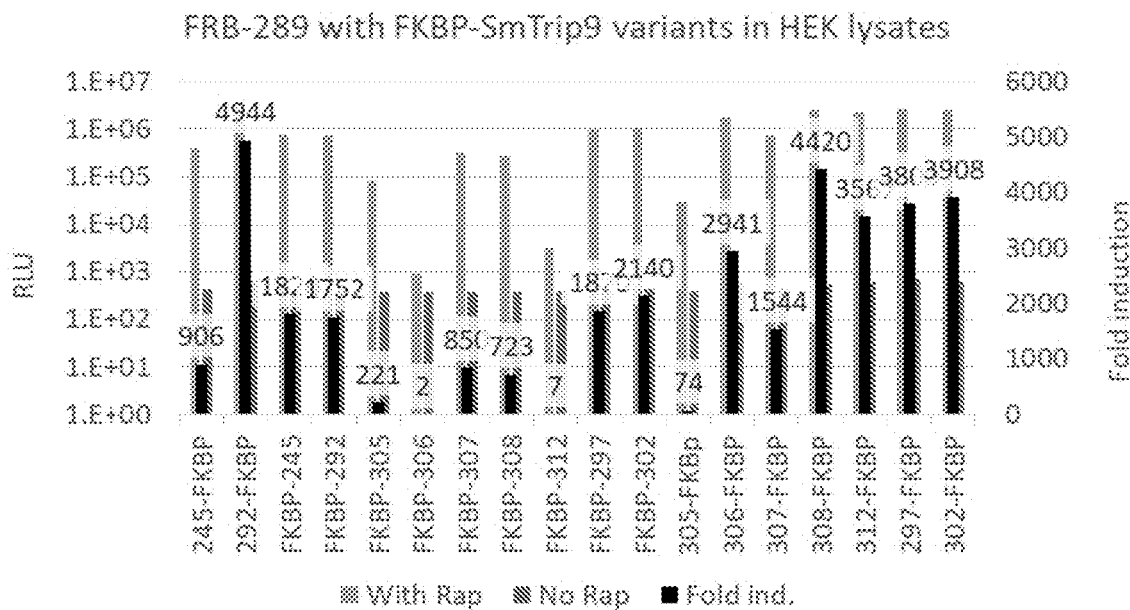
FIG. 49. Graph depicting the effect of β9 sequence truncations and extensions and construct orientation (β9-FKBP or FKBP-β9) on facilitated complementation with FRB-SmTrip10 pep289 (SEQ ID NO: 150) in HEK293 lysates. (LgTrip 3546 (SEQ ID NO: 51).
Figure 50:
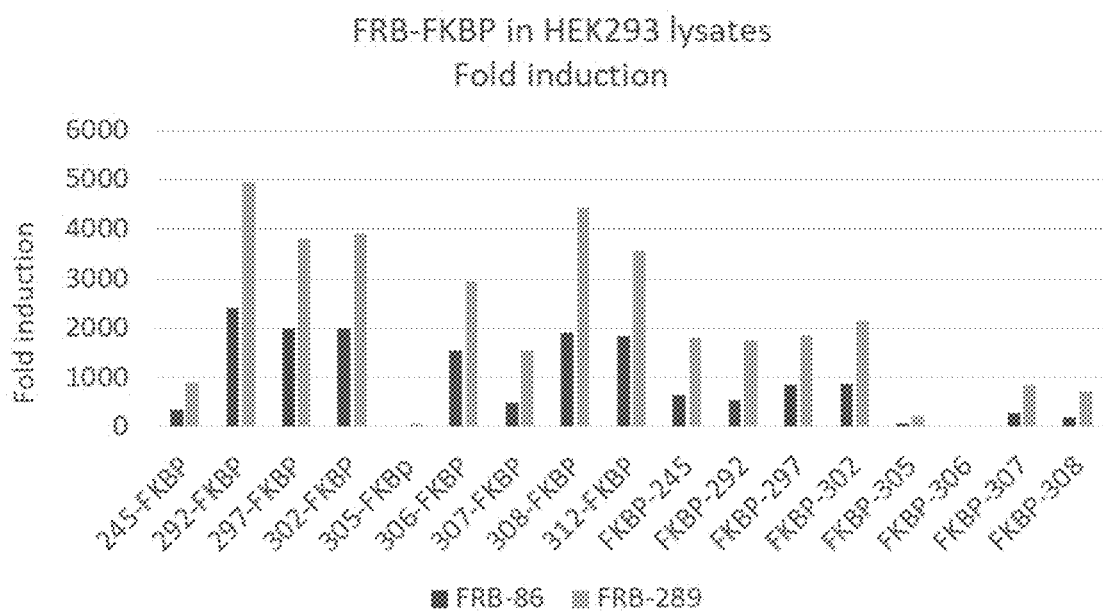
FIG. 50. Graph depicting the effect of β9 sequence truncations, extensions, and construct orientation (β9-FKBP or FKBP-β9) on fold induction (facilitated complementation/spontaneous complementation) with FRB-β10 (SmTrip10 pep86 (SEQ ID NO: 25) or SmTrip10pep289 (SEQ ID NO: 150)) in HEK293 lysates (Summary of FIGS. 48 and 49). (LgTrip 3546 (SEQ ID NO: 51)).

Measurement of FRB-FKBP Facilitated Complementation Using FRB-SmTrip10 Pep86 (HiBiT)/SmTrip10 Pep289 (VS-HiBiT) and SmTrip9 Sequences Fused to FKBP in Both Orientations in HEK Lysates Overnight cultures for FRB-SmTrip10 pep86 (HiBiT; SEQ ID NO: 25) or FRB-SmTrip10 pep289 (VS-HiBiT; SEQ ID NO: 150) and SmTrip9-like peptide sequences fused to FKBP were grown at 37° C. with 5% $CO_2$. Cells were transfected with 1 ug DNA (FKBP or FRB construct) per well using FuGENE protocol. Cells were washed in 1 ml DPBS. 1 ml DPBS was added and cultures were frozen at −80° C. for 10 min. Cultures were thawed at room temperature to lyse cells. Lysates were cleared by centrifugation for 10 min, and diluted 2-fold in PLB. SmTrip9/SmTrip10 peptide combinations were mixed 1:1 (vol:vol). Mixtures were diluted 1:5 into PLB+200 nM LgTrip 3546 (SEQ ID NO: 51) with or without 30 nM rapamycin, and reactions were incubated for 30 minutes at room temperature. Each reaction was combined with 50 ul of NanoGlo® buffer+50 uM Furimazine, and luminescence was measured at 5 minutes. Results are depicted in FIGS. 48-50.

Example 48

Figure 57:
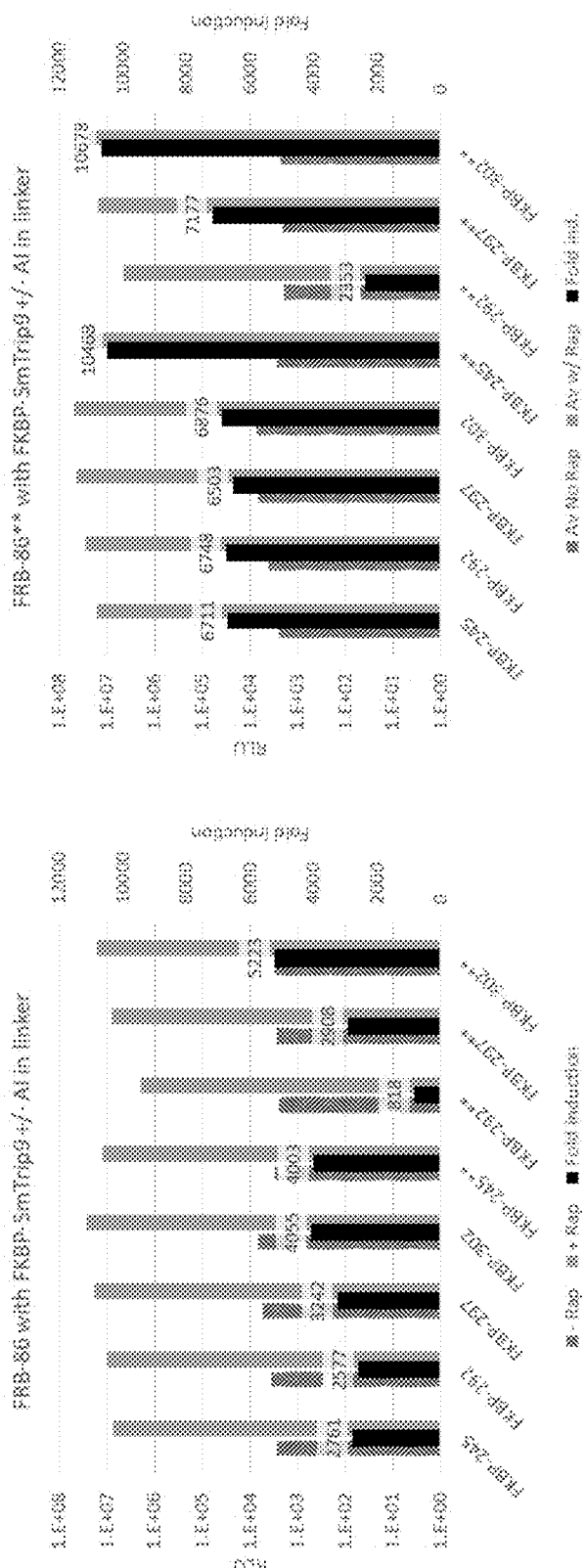
FIG. 57. Graph depicting FRB-FKBP facilitated complementation in E. coli lysates with AI(Ala-Ile) dipeptide absent from linker in constructs denoted by **. (LgTrip 3546 (SEQ ID NO: 51)).

Measurement of FRB-FKBP Facilitated Complementation Using FRB-SmTrip10 Pep86 (HiBiT)/SmTrip10 Pep289 (VS-HiBiT) and SmTrip9 Sequences Fused to FKBP in *E. coli* Lysates Overnight cultures for FRB-SmTrip10 pep86 (HiBiT; SEQ ID NO: 25) or FRB-SmTrip10 pep289 (VS-HiBiT; SEQ ID NO: 150) and SmTrip9-like peptide sequences fused to FKBP were grown in LB+100 ug/ml ampicillin from glycerol stocks. Cells were diluted 1:100 in LB+0.15% glucose+0.1% rhamnose+Amp and shook for 20 hours at 25° C. Cultures were diluted 1:4 in PLB and incubated 15 min at room temperature to lyse. SmTrip9/SmTrip10 peptide combinations were mixed 1:1 (vol:vol). Mixtures were diluted 1:5 into PLB+200 nM LgTrip 3546 (SEQ ID NO: 51) with or without 30 nM rapamycin, and reactions were incubated for 30 minutes at room temperature. Each reaction was combined with 50 ul of NanoGlo® buffer+50 uM Furimazine, and luminescence was measured at 5 minutes. Results are depicted in FIGS. 57, 59, 60, 62-63, 66-67, and 70-71. In FIG. 57, ** indicates that alanine-isoluecine (AI) in the linker directly upstream of SmTrip9 peptides or SmTrip10 peptides has been removed. Alanine-isoluecine is absent from C-terminal FKBP or FRB fusions with SmTrip9 peptide or SmTrip10 peptides, respectively, in all subsequent figures.

Example 49

Figure 58:
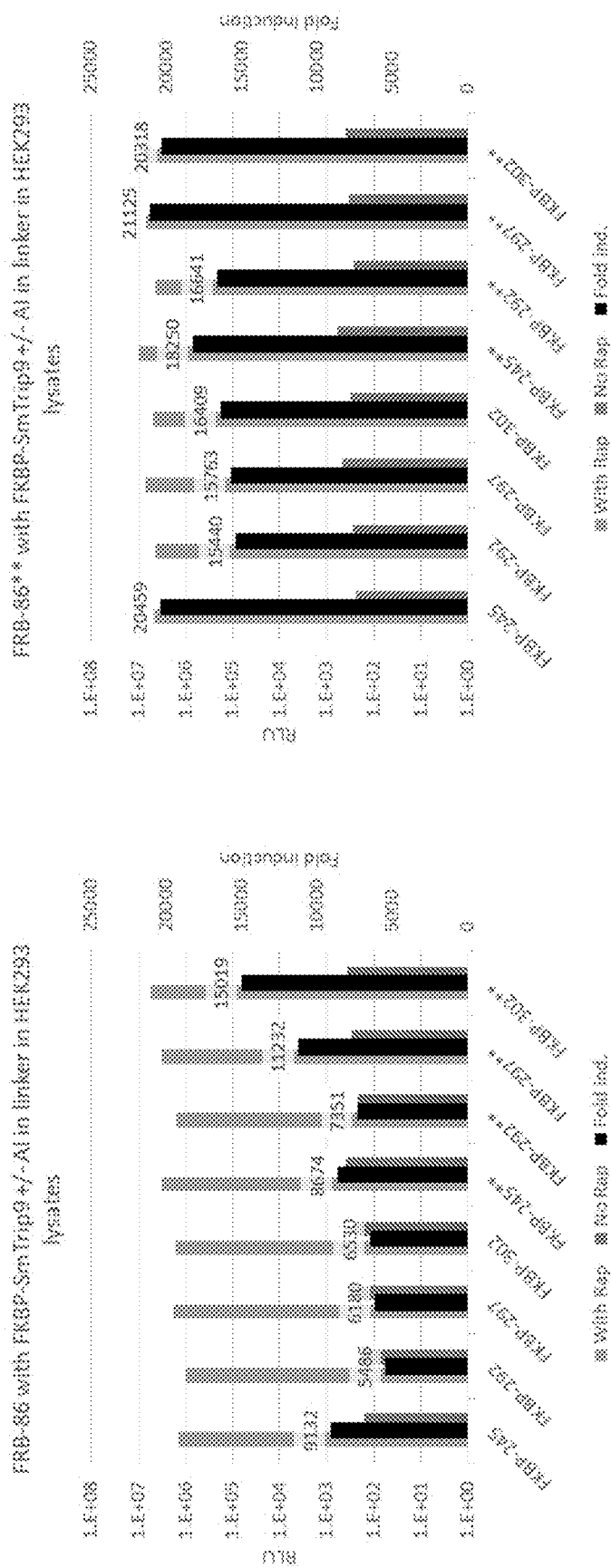
FIG. 58. Graph depicting FRB-FKBP facilitated complementation in HEK293 lysates with AI sequence dipeptide absent from linker in constructs denoted by **. (LgTrip 3546 (SEQ ID NO: 51)).
Figure 59:
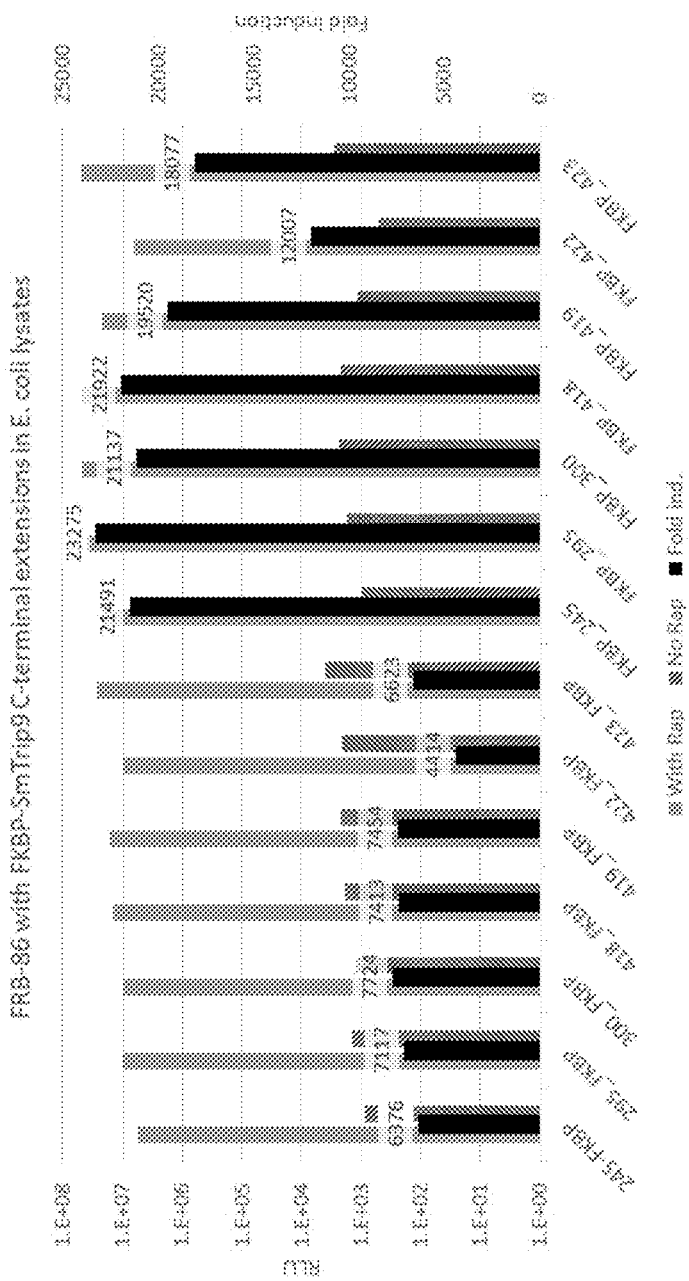
FIG. 59. Graph depicting FRB-FKBP facilitation of luminescent complex formation with FRB-SmTrip10 pep86 and C-terminally extended FKBP-SmTrip9 peptides in E. coli lysate. (LgTrip 3546 (SEQ ID NO: 51)).
Figure 60:
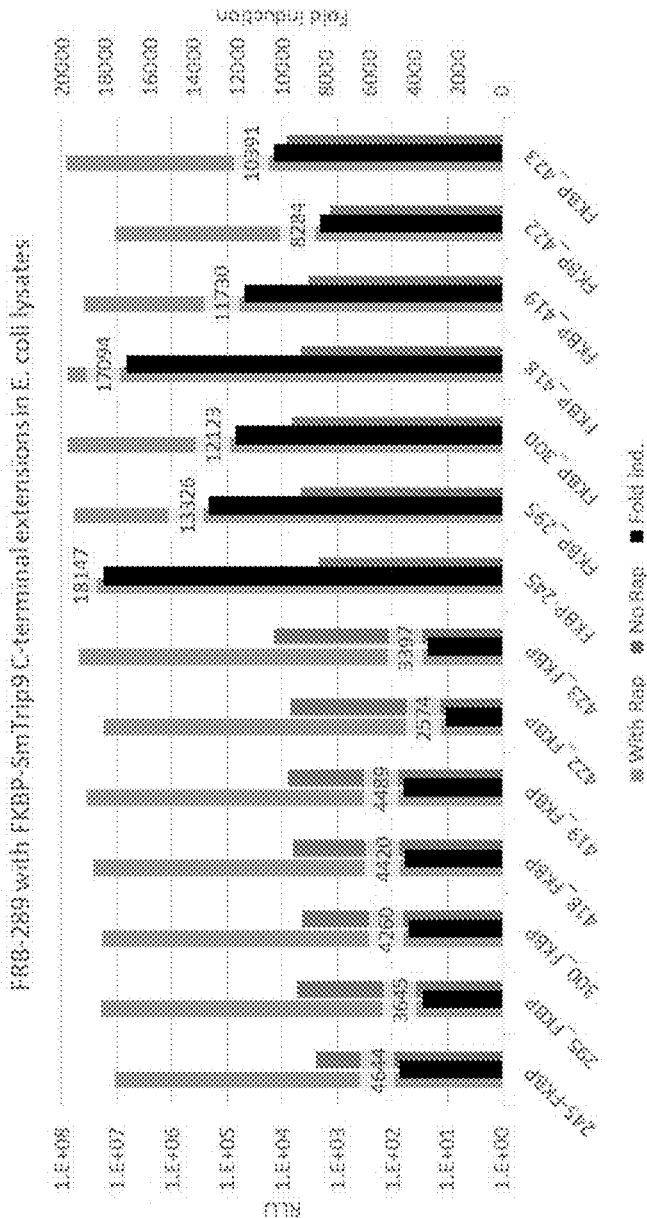
FIG. 60. Graph depicting FRB-FKBP facilitation of luminescent complex formation with FRB-SmTrip10 pep289 and C-terminally extended FKBP-SmTrip9 peptides in E. coli lysate. (LgTrip 3546 (SEQ ID NO: 51)).
Figure 61:
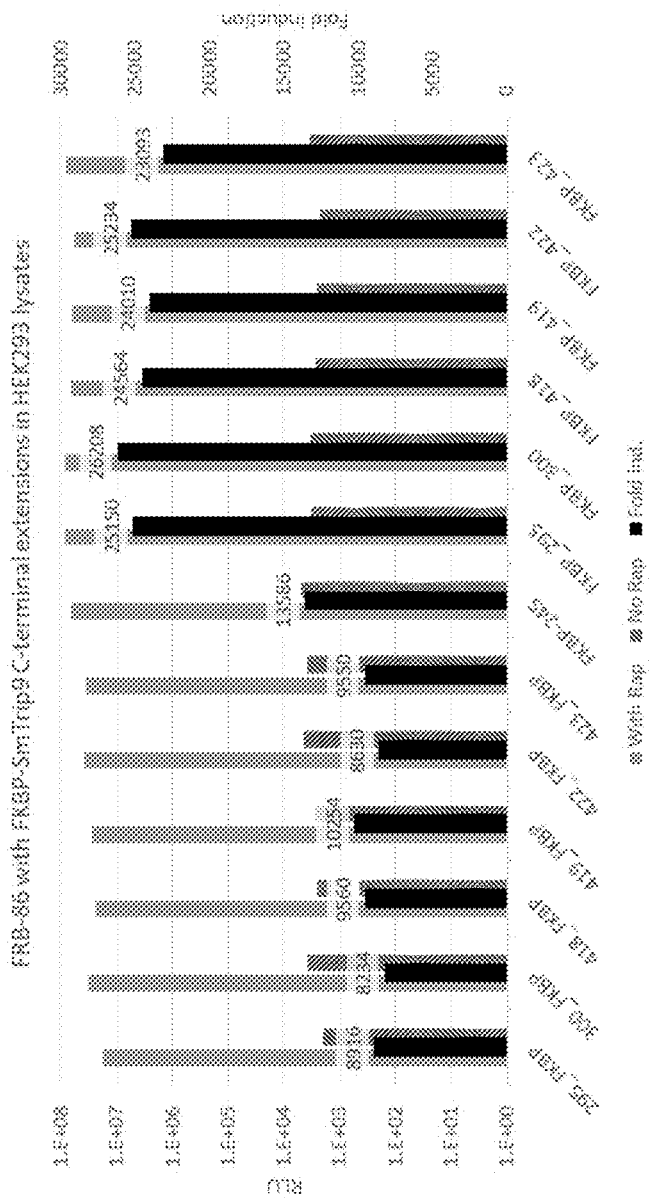
FIG. 61. Graph depicting FRB-FKBP facilitation of luminescent complex formation with FRB-SmTrip10 pep86 and C-terminally extended FKBP-SmTrip9 peptides in HEK293 lysate. (LgTrip 3546 (SEQ ID NO: 51)) FIG. 62. Graph depicting FRB-FKBP facilitation of luminescent complex formation with FRB-SmTrip10 pep86 and SmTrip9 peptide sequence truncations and extensions in FKBP fusions in E. coli lysate. (LgTrip 3546 (SEQ ID NO: 51)).
Figure 62:
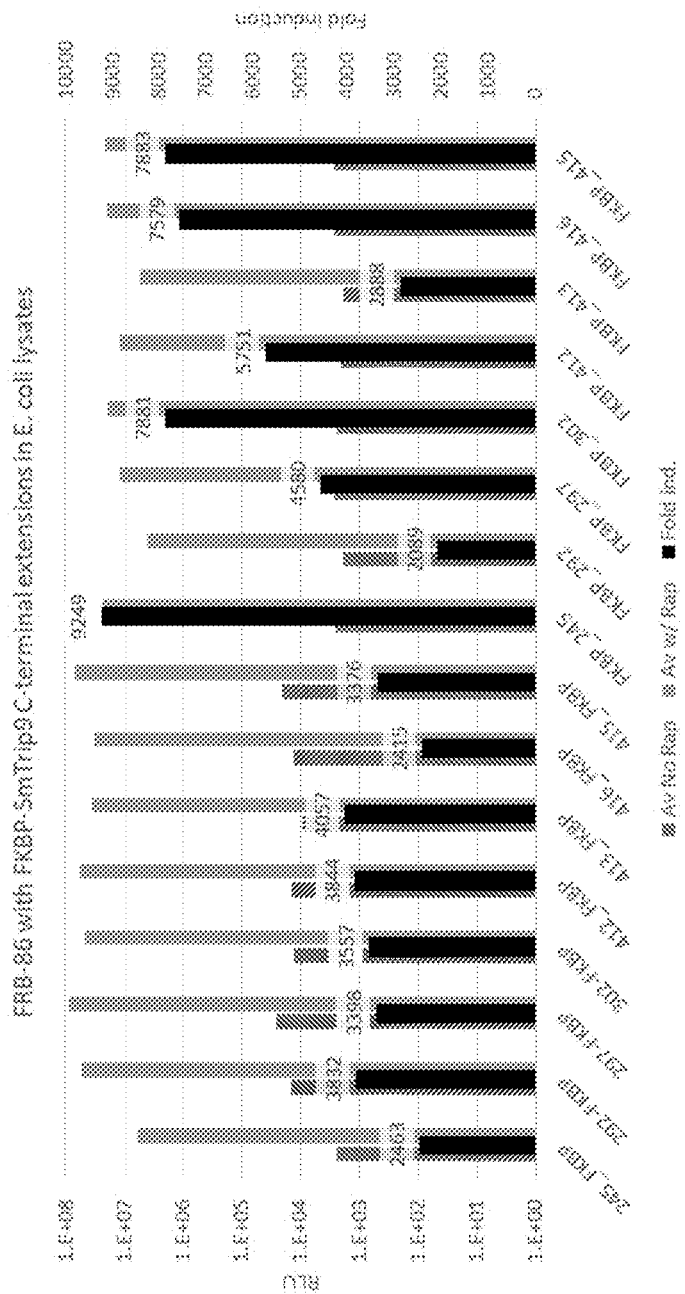
Figure 63:
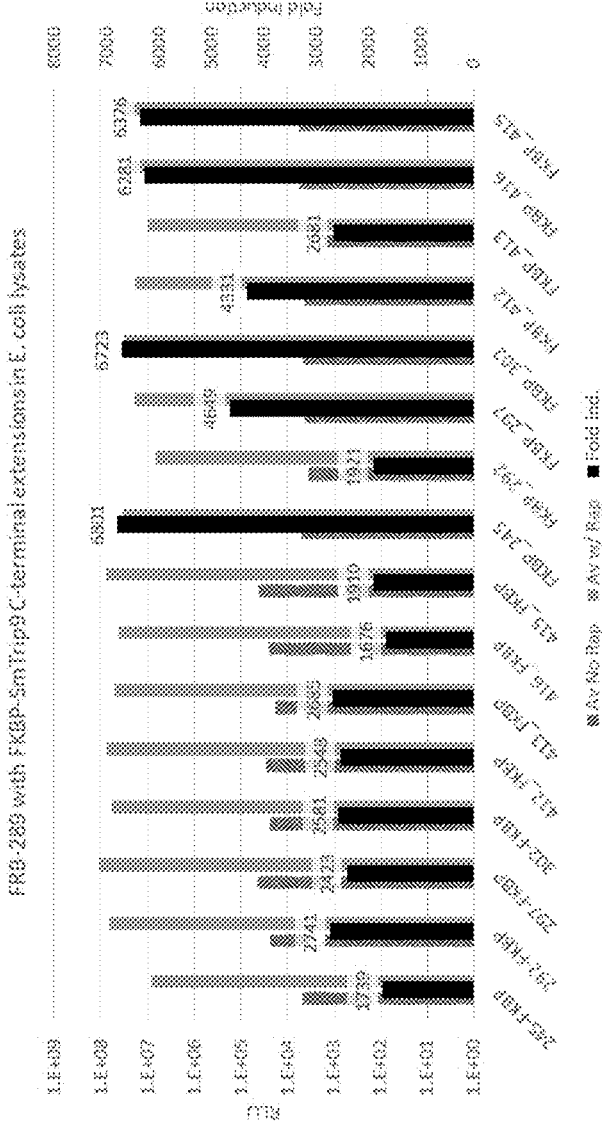
FIG. 63. Graph depicting FRB-FKBP facilitation of luminescent complex formation with FRB-SmTrip10 pep289 and SmTrip9 peptide sequence trunctions and extensions in FKBP fusions in E. coli lysate. (LgTrip 3546 (SEQ ID NO: 51)).
Figure 64:
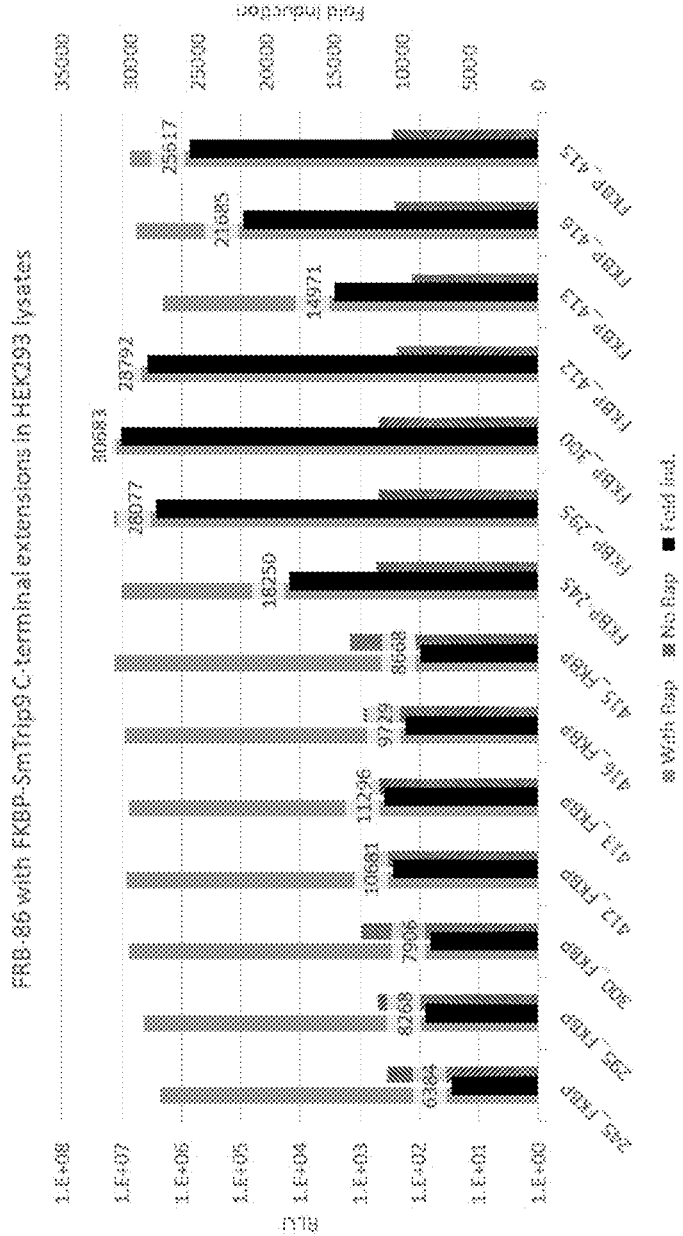
FIG. 64. Graph depicting FRB-FKBP facilitation of luminescent complex formation with FRB-SmTrip10 pep86 and SmTrip9 peptide sequence trunctions and extensions in FKBP fusions in HEK293 lysate. (LgTrip 3546 (SEQ ID NO: 51)).
Figure 65:
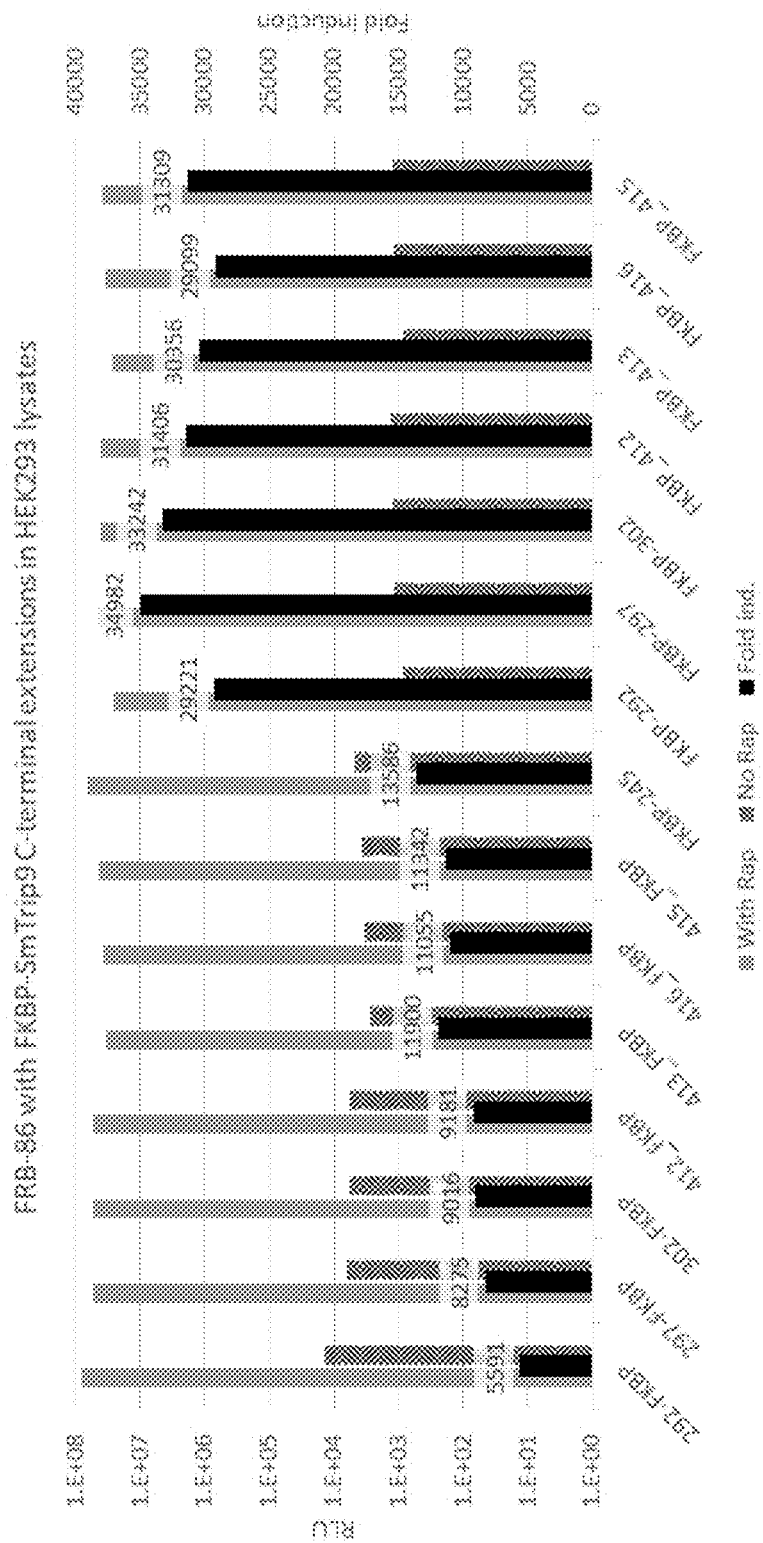
FIG. 65. Graph depicting FRB-FKBP facilitation of luminescent complex formation with FRB-SmTrip10 pep86 and SmTrip9 peptide sequence trunctions and extensions in FKBP fusions in HEK293 lysate. (LgTrip 3546 (SEQ ID NO: 51)).
Figure 66:
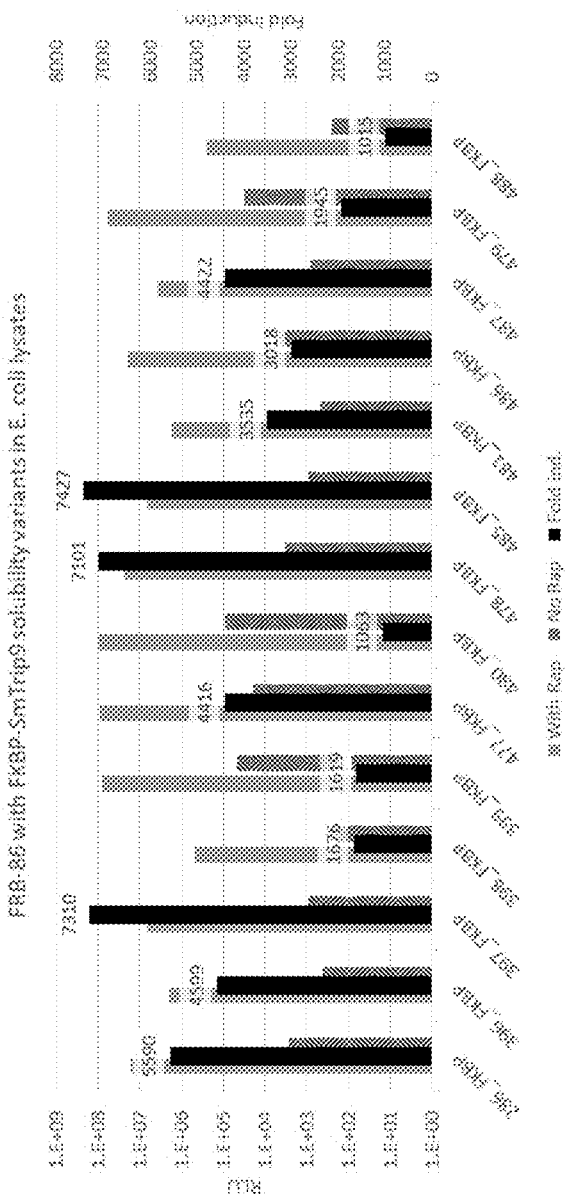
FIG. 66. Graph depicting FRB-FKBP facilitation of luminescent complex formation with FKBP-SmTrip9 solubility variants and FRB-SmTrip10 pep86 in E. coli lysate. (LgTrip 3546 (SEQ ID NO: 51)).
Figure 67:
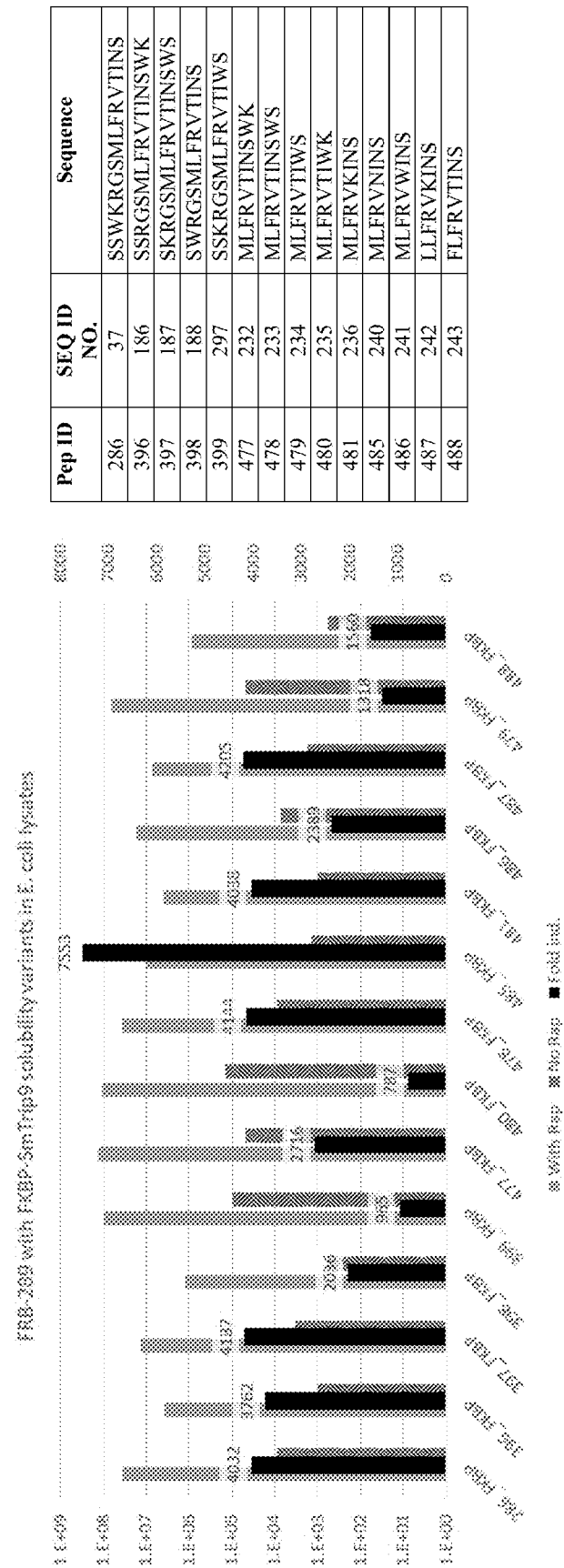
FIG. 67. Graph depicting FRB-FKBP facilitation of luminescent complex formation with FKBP-SmTrip9 solubility variants and FRB-SmTrip10 pep289 in E. coli lysate. (LgTrip 3546 (SEQ ID NO: 51)).
Figure 68:
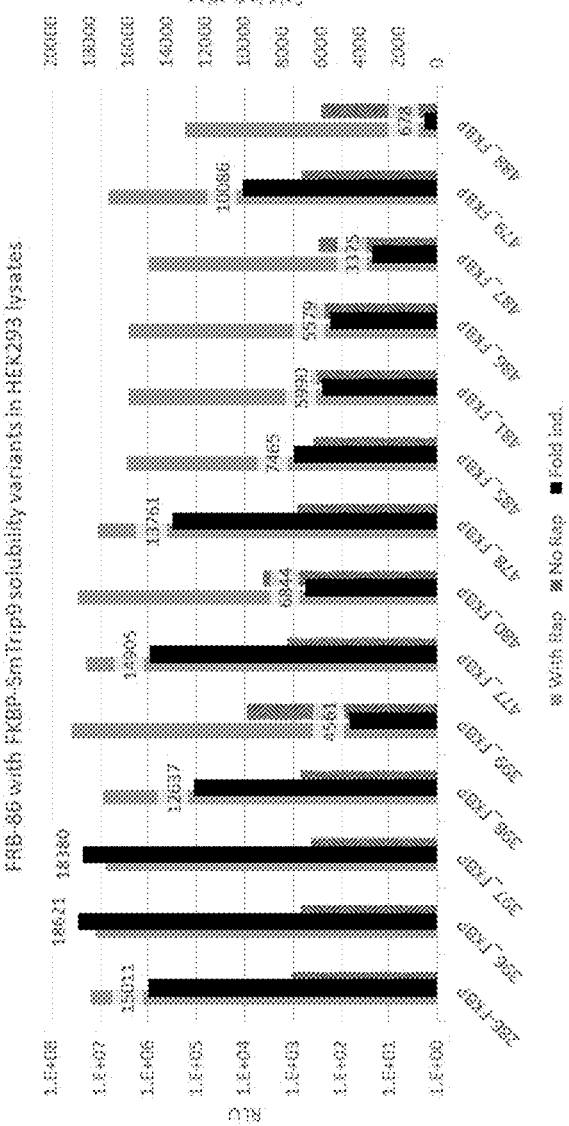
FIG. 68. Graph depicting FRB-FKBP facilitation of luminescent complex formation with FKBP-SmTrip9 solubility variants and FRB-SmTrip10 pep86 in HEK293 lysate. (LgTrip 3546 (SEQ ID NO: 51)).
Figure 69:
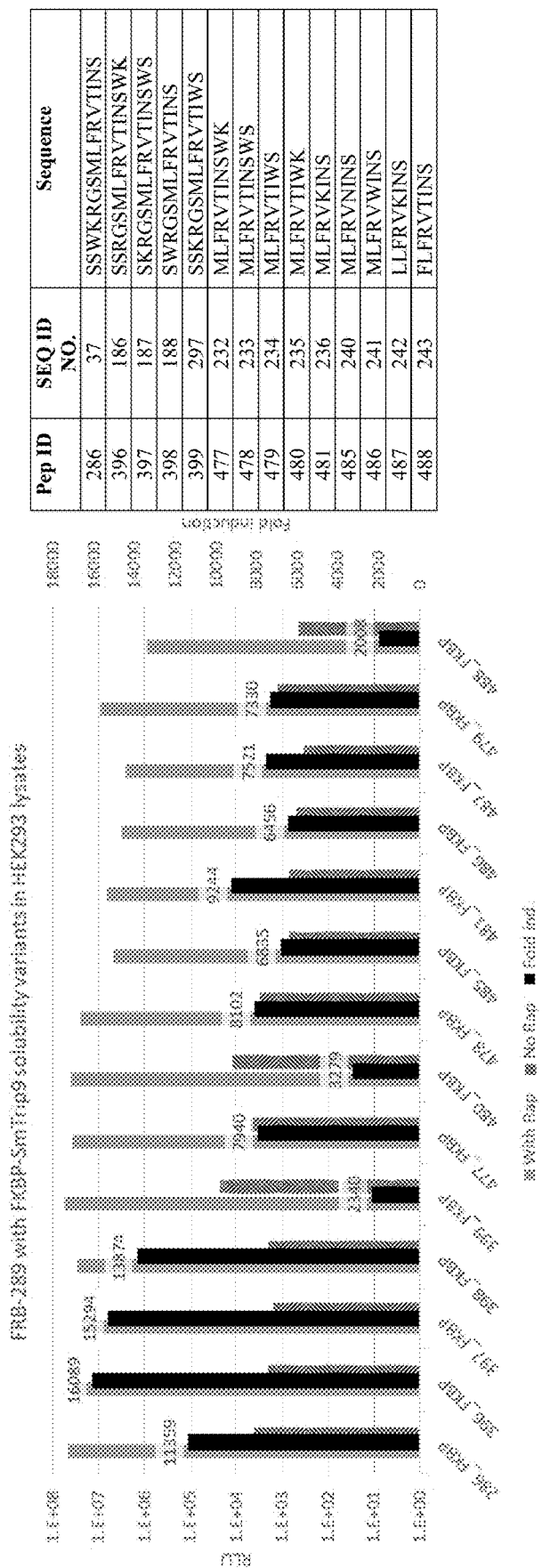
FIG. 69. Graph depicting FRB-FKBP facilitation of luminescent complex formation with FKBP-SmTrip9 solubility variants and FRB-SmTrip10 pep289 in HEK293 lysate. (LgTrip 3546 (SEQ ID NO: 51)).
Figure 70:
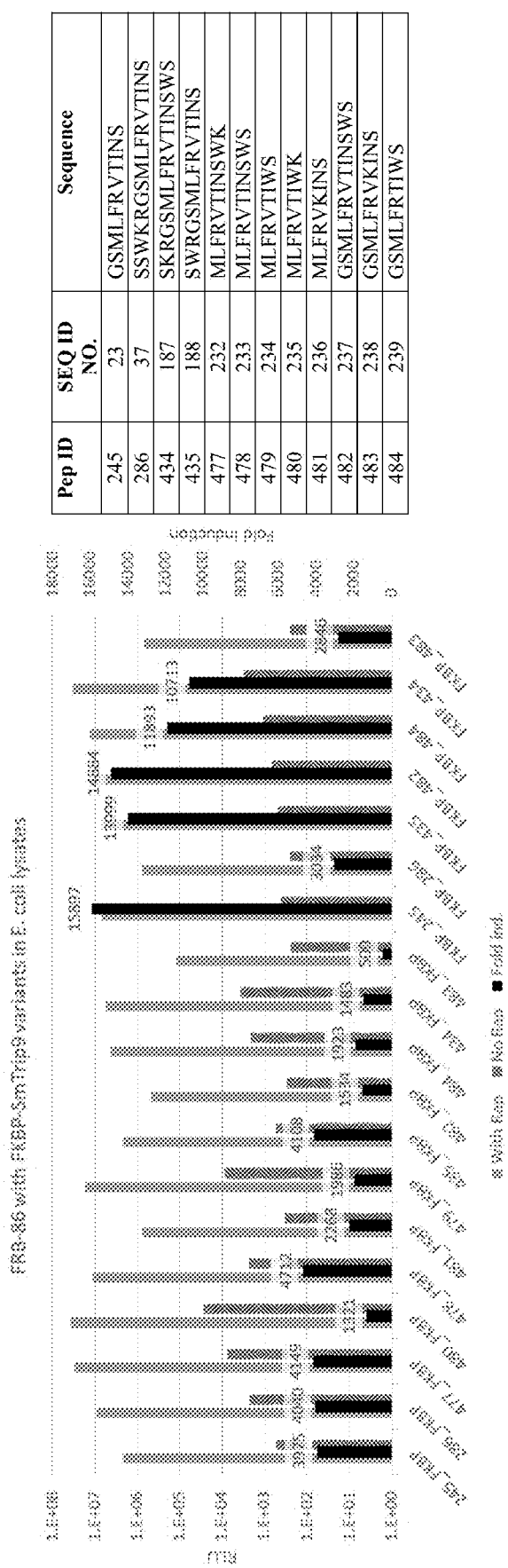
FIG. 70. Graph depicting FRB-FKBP facilitation of luminescent complex formation with FKBP-SmTrip9 solubility variants and FRB-SmTrip pep86 in E. coli lysate. (LgTrip 3546 (SEQ ID NO: 51)).
Figure 71:
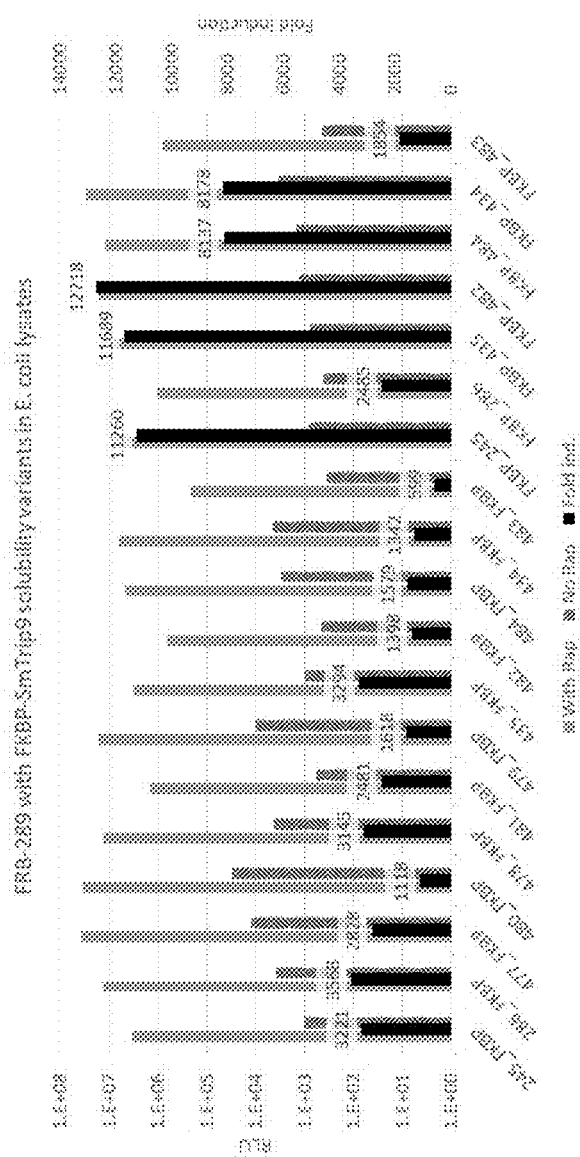
FIG. 71. Graph depicting FRB-FKBP facilitation of luminescent complex formation with FKBP-SmTrip9 solubility variants and FRB-SmTrip pep289 in E. coli lysate. (LgTrip 3546 (SEQ ID NO: 51)).
Figure 72:
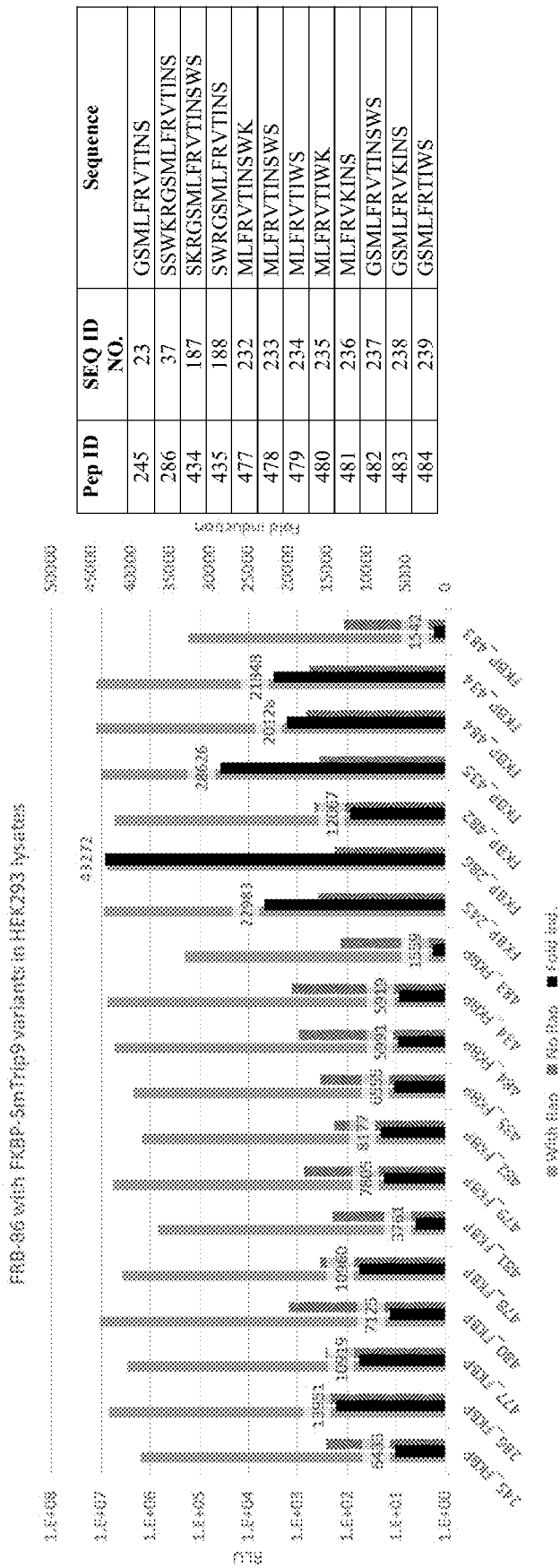
FIG. 72. Graph depicting FRB-FKBP facilitation of luminescent complex formation with FKBP-SmTrip9 solubility variants and FRB-SmTrip pep86 in HEK293 lysate. (LgTrip 3546 (SEQ ID NO: 51)).
Figure 73:
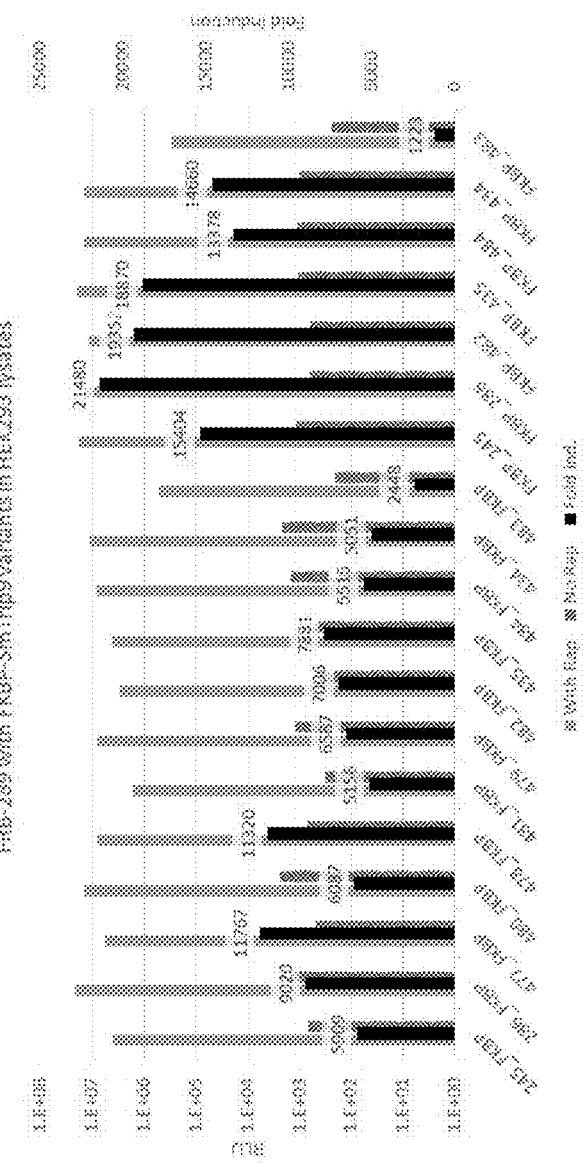
FIG. 73. Graph depicting FRB-FKBP facilitation of luminescent complex formation with FKBP-SmTrip9 solubility variants and FRB-SmTrip pep289 in HEK293 lysate. (LgTrip 3546 (SEQ ID NO: 51)).

Measurement of FRB-FKBP Facilitated Complementation Using FRB-SmTrip10 Pep86 (HiBiT)/SmTrip10 Pep289 (VS-HiBiT) and SmTrip9 Sequences Fused to FKBP in HEK293 Lysates Overnight cultures for FRB-SmTrip10 pep86 (HiBiT; SEQ ID NO: 25) or FRB SmTrip10 pep289(VS-HiBiT; SEQ ID NO: 150) and SmTrip9-like peptide sequences fused to FKBP were grown at 37° C. with 5% $CO_2$. Cells were transfected with 3 ug DNA (FKBP or FRB construct) per well using FuGENE protocol. Cells were washed in 1 ml DPBS. 1 ml DPBS was added and cultures were frozen at −80° C. for 10 min. Cultures were thawed at room temperature to lyse cells. Lysates were cleared by centrifugation for 10 min, and diluted 2-fold in PLB. SmTrip9/SmTrip10 peptide combinations were mixed 1:1 (vol:vol). Mixtures were diluted 1:5 into PLB+200 nM LgTrip 3546 (SEQ ID NO: 51) with or without 30 nM rapamycin, and reactions were incubated for 30 minutes at room temperature. Each reaction was combined with 50 ul of NanoGlo® buffer+50 uM Furimazine, and luminescence was measured at 5 minutes. Results are depicted in FIGS. 58, 61, 64-65, 68-69, and 72-73. In FIG. 58, ** indicates that alanine-isoluecine (AI) in the linker directly upstream of SmTrip9 peptides or SmTrip10 peptides has been removed. Alanine-isoluecine is absent from C-terminal FKBP or FRB fusions with SmTrip9 peptides or SmTrip10 peptides, respectively, in all subsequent figures.

Example 50

Biochemical Analysis (Kd and Bmax) of Varied SmTrip9 Sequences

Results are depicted in FIGS. 74-76.
SmTrip9-Like Peptide Titrations

LgTrip 3546 (SEQ ID NO: 51) was diluted to 0.2 nM in TBS+0.01% BSA+0.01% Tergitol. 100 uM SmTrip10 pep86 (SmHiTrip; SEQ ID NO: 25) was prepared in TBS+0.01%

BSA+0.01% Tergitol. 20 uM solutions were prepared of each SmTrip9-like peptide in the SmTrip10 pep86 solution. 2× serial dilutions of each SmTrip9-like peptide were prepared using the SmTrip10 pep86 solution as a diluent. Peptide dilutions were combined with LgTrip 3546 (SEQ ID NO: 51) solution, 1:1, and incubated for 10 minutes.

TBS+0.01% BSA+0.01% Tergitol+20 uM Furimazine (Fz) detection reagent was added, 1:1.

Luminescence was read at 10 min.

SmTrip10 Pep86 (HiBiT) Titrations

LgTrip 3546 (SEQ ID NO: 51) was diluted to 0.2 nM in TBS+0.01% BSA+0.01% Tergitol. 20 uM SmTrip9-like peptide solutions were prepared in TBS+0.01% BSA+0.01% Tergitol. SmTrip10 pep86 was added to 100 uM in each SmTrip9-like peptide solution. 2× serial dilutions of each SmTrip10 pep86 (SEQ ID NO: 25) were prepared using the SmTrip9-like peptide solutions as a diluent. Peptide dilutions were combined with LgTrip 3546 (SEQ ID NO: 51) solution 1:1 and incubated for 10 minutes. TBS+0.01% BSA+0.01% Tergitol+20 uM Furimazine (Fz) detection reagent was added, 1:1. Luminescence was read at 10 min.

Example 51

Solubility of Synthetic SmTrip9 Peptides

Synthetic peptides were synthesized by Peptide2.0 with termini blocked (N-terminal acetylation and C-terminal amidation) unless otherwise noted. Peptides were dissolved in nuclease-free water to ~1 mM and mixed on rotater at 4° C. for 30 min. Following centrifugation for 10 min at top speed, peptides were diluted 1:50 in water and quantified on NanoDrop. Peptides were stored at −20° C. until use. Peptides were deemed soluble if they remained in solution after 3 freeze/thaw cycles in which peptides were thawed in a 22° C. water bath, kept at 4° C., and frozen at −20° C. Solubility of synthetic peptides is depicted in FIG. 77.

Example 52

Figure 78A:
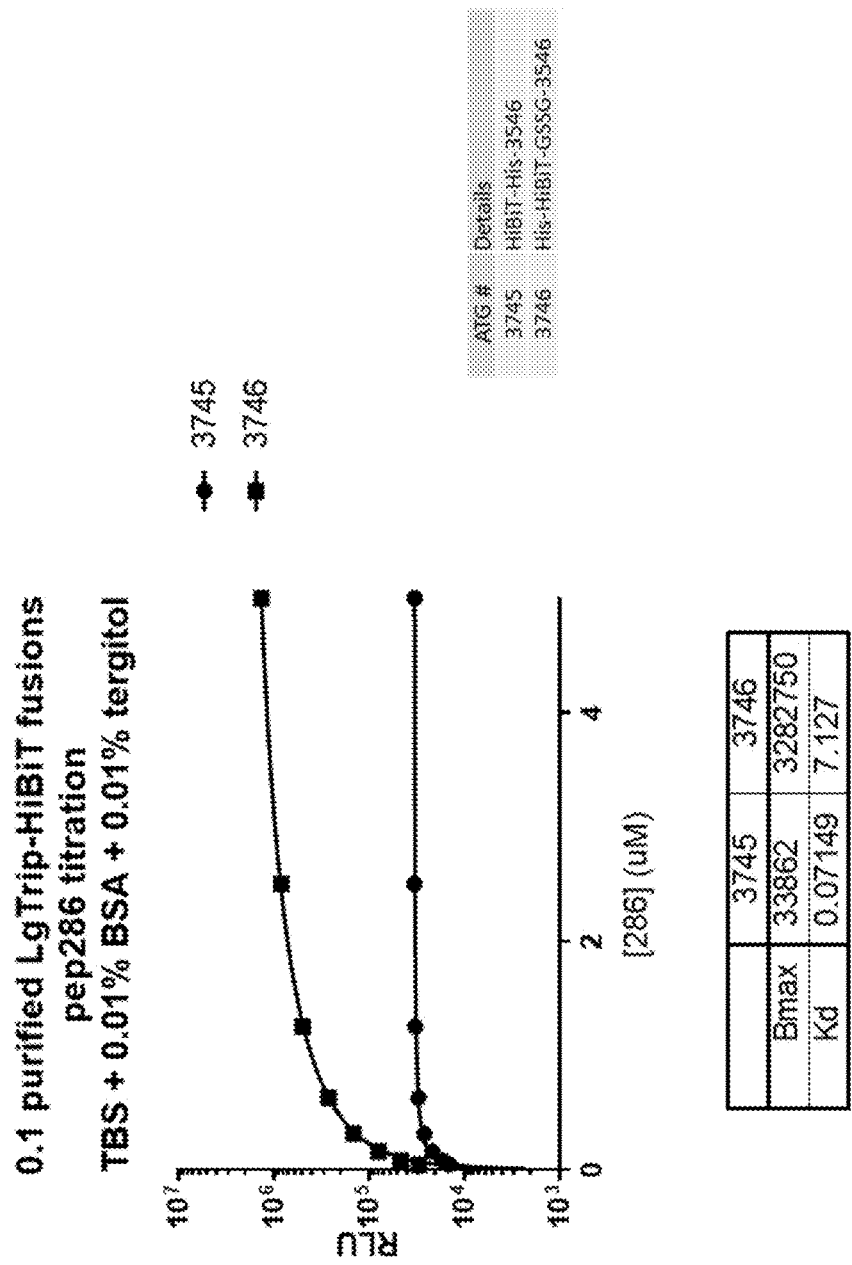
FIG. 78A-B. (A) Graph depicting the affinity of SmTrip9 pep286 (SEQ ID NO: 37) for SmTrip10 pep86 (HiBiT)/LgTrip fusions (SEQ ID NO: 210 and 212). (B) Graph depicting the affinity of SmTrip9 pep759 (SEQ ID NO: 496) for various SmTrip10 pep86 (HiBiT)/LgTrip fusions.

Circularly Permuted LgBiT
SmTrip9/Pep286 Affinity and Bmax for SmTrip10 Pep 86 (HiBiT)-LgTrip 3546Fusions A fusion polypeptide comprising a SmTrip10 pep86 (SmHiTrip; SEQ ID NO: 25) sequence fused to the front of LgTrip 3546 (SEQ ID NO: 51) was generated and experiments were conducted to monitor complex formation and luminescence of the SmTrip10 pep86 HiBiT-LgTrip fusions with SmTrip9 pep286 (SEQ ID NO: 37) (FIG. 78).

Overnight cultures were grown in LB+100 ug/ml ampicillin from glycerol stocks. Cells were diluted 1:100 in LB+0.15% glucose+0.1% rhamnose+Amp and shaken for 20 hr at 25° C. 800 µl culture was lysed in FastBreak and each SmTrip10 pep86-LgTrip fusion was purified using the HisLink protocol. 2-fold SmTrip9 pep286 (SEQ ID NO: 37) serial dilutions starting at 10 uM were made in TBS+0.01% Tergitol+0.01% BSA containing 0.2 nM SmTrip10 pep86-LgTrip fusion (ATG 3745 (SEQ ID NO: 211) or ATG 3746 (SEQ ID NO: 213)). Reactions were pre-incubated for 10 minutes at room temperature. TBS+0.01% Tergitol+0.01% BSA with 20 uM Furimazine (Fz) was added to samples 1:1 (vol:vol).

Luminescence was Read on GloMax® Luminometer at 10 Min.

Figure 78B:
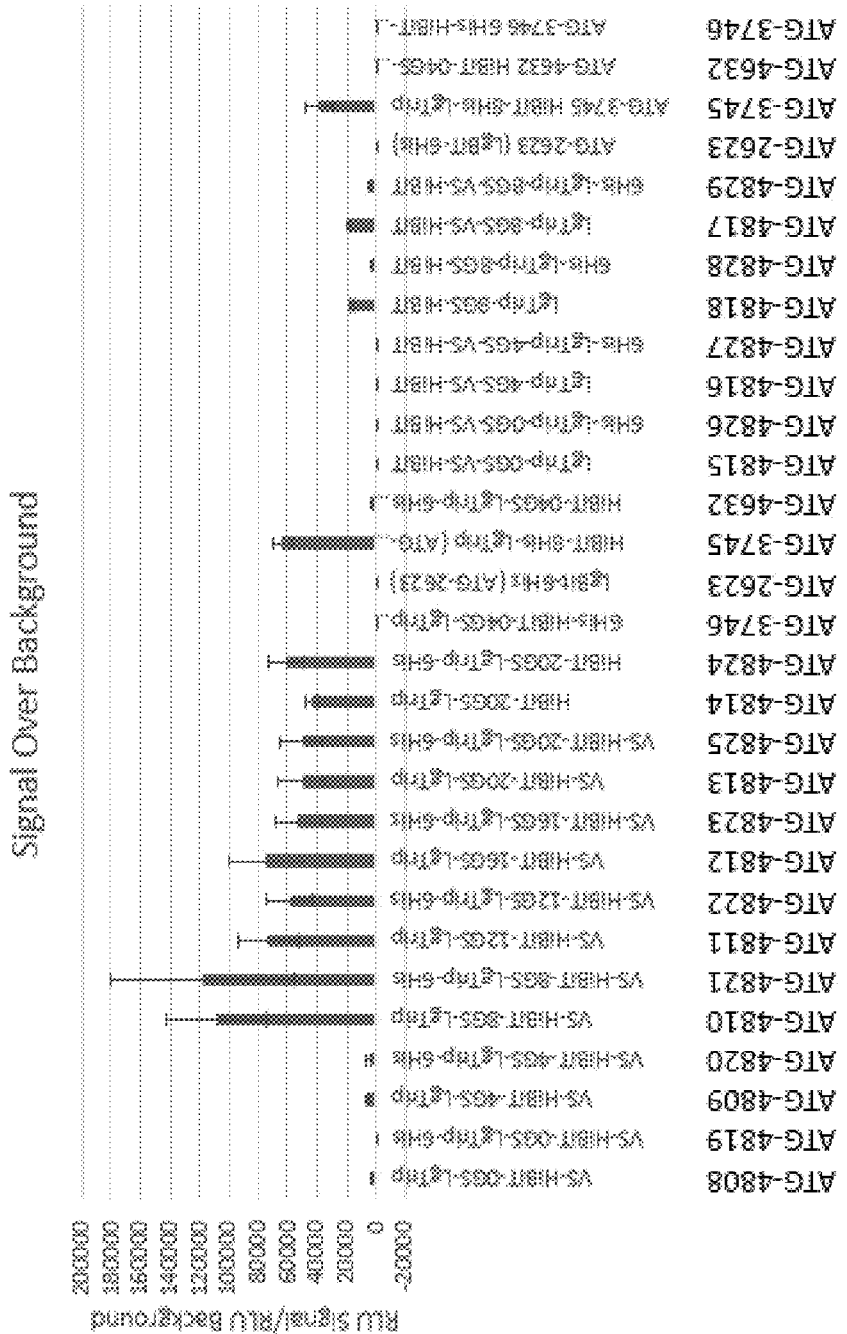

SmTrip9/pep759 affinity for various SmTrip10 pep 86 (HiBiT)-LgTrip 3546fusions From pellets of induced cell culture, pellets were resuspended in 1/10 of the original culture volume (e.g. a 50 mL culture would be resuspended in 5 mL) using 1× TBS+0.01% BSA. A lysis buffer was prepared using 100 parts Fast Break® Buffer, 10 Parts RQ1 RNAse free DNAse, and 1 part 1 M DTT (e.g. 650 µL Fast Break® Buffer+65 µL RQ1 RNAse free DNAse, and 6.5 µL 1 M DTT or equivalent scaling). 1 part Lysis buffer was added to 9 parts cell suspension (e.g. 33.3 µL Lysis buffer+ 300 uL suspension) in a 15 mL tube. Incubated at 4° C. for 30 minutes while mixing (using a rotary shaker). A 4 µM solution of pep 759 was prepared in 1× TBS+0.01% BSA. 50 µL of 4 µM pep759 was added to 50 µL of each lysate in a 96 well plate in triplicate. 50 µL of each lysate was separately mixed with 50 µL of 1× TBS+0.01% BSA buffer in triplicate. NanoGlo® Reagent was prepared by mixing 100 parts NanoGlo® Buffer with 1 part Furimazine (e.g. 10 mL buffer+100 uL furimazine). 100 µL of NanoGlo® reagent was added to each well. Luminescence was measured using Glomax® Multi instrument kinetic cycles. Luminescence measurements were compared after about 29 minutes. Luminescence readings for samples with pep759 were divided by the corresponding measurement of the same lysate without pep759. Results are depicted in FIG. 78B. Two batches of cultures were used to generate data: one was from inductions of 50 mL cultures (the right side, ATG-4808 through and including ATG-4632) and the other was from inductions of 3 mL cultures (left side, starting with ATG-4815 through and including ATG-3746). Some constructs were present in both tests (ATG-2623, ATG-3745, ATG-3746, ATG-4632).

Example 53

Detergent Titration

Experiments were conducted during development of embodiments herein to determine the impact of various detergents on NanoLuc® (SEQ ID NO: 3), LgBiT (SEQ ID NO: 11), and LgTrip 3546 (SEQ ID NO: 51) complexes with the dipeptide, pep263 (SEQ ID NO: 35).

Figure 79:
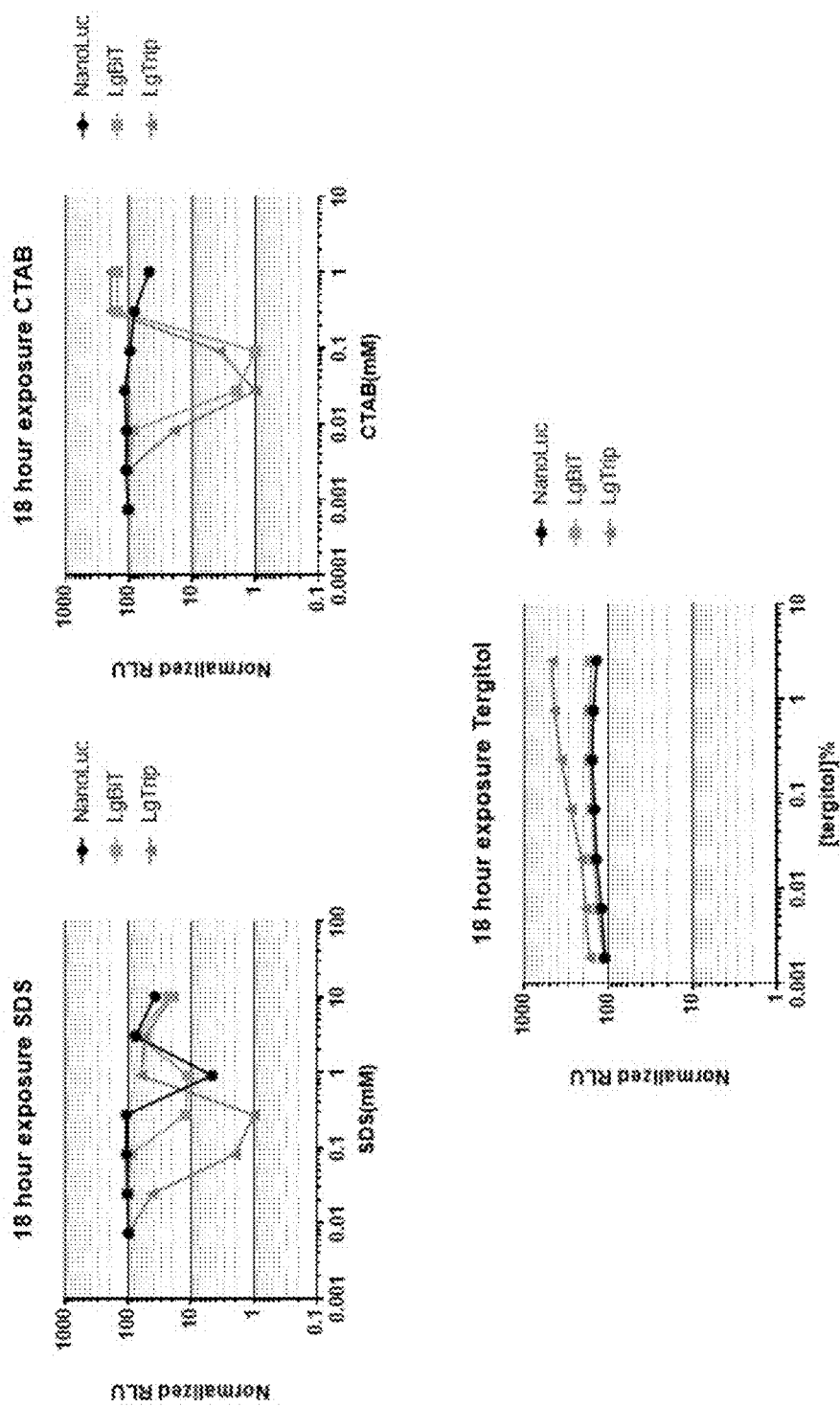
FIG. 79. Graphs depicting bioluminescence following an 18 hour exposure to increasing detergent concentrations. NanoLuc® (SEQ ID NO: 3), LgBiT (SEQ ID NO: 11), (LgTrip 3546 (SEQ ID NO: 51)).

Exposure Experiments 500 ul of 20 mM SDS or 2 mM CDTA or 5% Tergitol was added to a deep well plate. 3× serial dilutions were prepared of each detergent in TBS+0.01% BSA (150 ul in 350 ul). 100 ul of each dilution was combined with 100 ul of either 2 nM NanoLuc®, LgBiT, or LgTrip, and samples were incubated for 18 hours. Samples were diluted 1:100 in TBS+0.01% BSA (5 ul in 495 ul). 50 ul of each sample was combined in triplicate with 50 ul of TBS+0.01% BSA+20 uM Furimazine (Fz) for NanoLuc® or TBS+0.01% BSA+20 uM Furimazine (Fz)+2 uM pep263 for LgBiT and LgTrip. Luminescence of samples was read on GMM+3 minutes after reagent addition. Results of prolonged exposure to detergent on LgBiT, LgTrip 3546, and NanoLuc® are depicted in FIG. 79.

Figure 80:
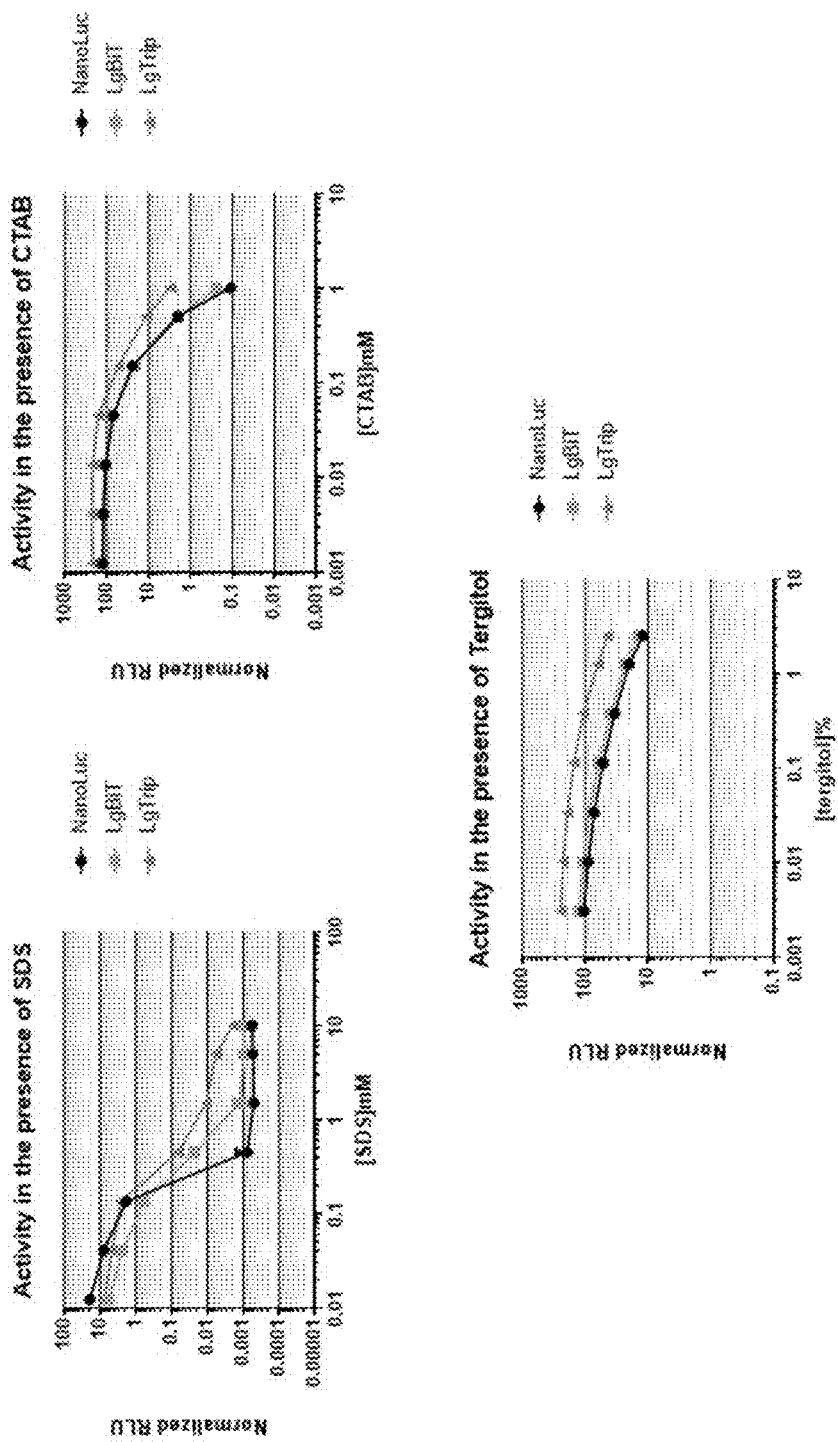
FIG. 80. Graphs depicting enzyme activity in the presence of increasing detergent concentrations. NanoLuc® (SEQ ID NO: 3), LgBiT (SEQ ID NO: 11), LgTrip 3546 (SEQ ID NO: 51).

Activity Experiments 20 ml of 20 uM Fz was prepared in TBS+0.01% BSA. 2 ml of 20 mM SDS and 2 mM of CDTA and 5% Tergitol were added to a deep well plate. 20 uM Fz was added to each sample (8 ul). 2× serial dilutions were prepared of each detergent in 20 uM Fz solution (1 ml to 1 ml). A solution of 400 µM NanoLuc® in TBS+0.01% BSA was prepared. A solution of 400 µM LgBiT+1 uM pep263 (SEQ ID NO: 35) in TBS+0.01% BSA was prepared. A solution of 400 µM LgTrip 3546 (SEQ ID NO: 51)+1 uM pep263 (SEQ ID NO: 35) in TBS+0.01% BSA was prepared. 50 ul of each enzyme solution was combined with 50 ul of the detergent titrations, placed in luminometer, and read after a 3 minute incubation at RT. Results of LgBiT, LgTrip and NanoLuc® activity in the presence of detergent are depicted in FIG. 80.

Example 54

Reversibility of FRB-FKBP Facilitated Complex Formation

Figure 81:
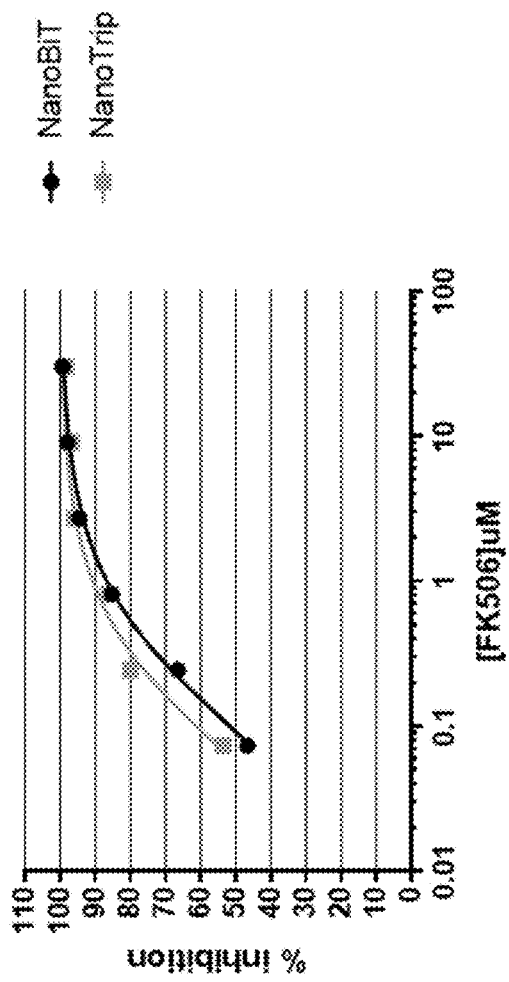
FIG. 81. Graph demonstrating the reversibility of FRB-FKBP facilitated bioluminescent complex formation with LgBiT (SEQ ID NO: 11) and LgTrip 3546 (SEQ ID NO: 51).

Experiments were conducted during development of embodiments herein to demonstrate the reversibility of bioluminescent complex formation. Media was aspirated from a T75 growth flask of HEK293 cells. Cells were washed with 10 ml of DPBS and trypsinized by adding 3 ml of Tryple Express Trypsin. After a 3 minute incubation at 37° C., 10 ml of growth media (DMDM+10% FBS) was added to the flask, mixing cells with pipette. Cells were pelleted at 200 rpm for 5 minutes. Media was aspirated and replaced by fresh media. Cells were counted on a T20 cell counter and diluted to 200,000 cells/ml. 3 ml of the cell suspension was added to each well of a six well plate. Cells were grown overnight at 37° C. with 5% $CO_2$. To transfect the cells, DNA was diluted for each construct to a concentration of 100 ng/ul and 3.3 ug of DNA was added in a final volume of 155 ul of OptiMEM for each construct (FKBP-SmBiT, FRB-LgBiT, FRB-SmTrip10 pep86 (HiBiT), FKBP-SmTrip9 pep245). 9.9 ul of FugeneHd was added to the diluted DNA and incubated for 15 minutes. 150 ul of each DNA complex was then added to cells plated in a 6 well plate. Cells were grown overnight at 37° C. with 5% $CO_2$. After aspirating media, cells were washed once with DPBS (Life Technologies Cat. No. 14190) and then frozen in a fresh 1 ml of DPBS at −80° C. The samples were then thawed to lyse cells. FRB and FKBP constructs for NanoBiT® (FKBP-SmBiT+FRB-LgBiT) and NanoTrip™ (FRB-SmTrip10 pep86 (HiBiT)+FKBP-SmTrip9 pep245+200 nM purified LgTrip 3546 (SEQ ID NO: 51)) were combined and incubated with 30 nM Rapamyacin for 30 minutes. A dilution series of FK506 was prepared in DMSO starting at 10 mM. 3-fold serial dilutions were performed in DMSO (30 ul into 70 ul). 200 ul of each FRB-FKBP combination was aliquoted into 8wells of a 96 well PCR tray. Upon addition of 2 ul of the FK506 dilution series, each sample was incubated at 37° C. for 6 hours. 50 ul of each sample was combined with 50 ul of TBS+0.01% BSA+20 uM Furimazine (Fz), incubated for 3 minutes, and read on GMM+. Results are depicted in FIG. 81.

Example 55

LgTrip/SmTrip9 Titration with SmTrip10 Peptides

Experiments were conducted during development of embodiments herein to analyze titrations of LgTrip 3546 (SEQ ID NO: 51) and SmTrip9 pep286 (SEQ ID NO: 37) with various SmTrip10 peptides. Data was normalized to SmTrip10 pep86 (HiBiT) values. SmTrip10 pep86 (HiBiT) is SmHiTrip10 (SEQ ID NO: 25).

Peptide stocks were diluted to 250 uM in water. A SmTrip9 pep286 (SEQ ID NO: 37) solution (10 uM in final reaction) was prepared in OptiMEM+10% FBS. A 2-fold serial dilution of each SmTrip10 peptide was performed in the OptiMEM solution containing SmTrip9 pep286. The highest concentration of the SmTrip10 peptide was 15 uM (final in reaction). A 10× stock (1 nM) of LgTrip 3546 (SEQ ID NO: 51) was prepared in OptiMEM+10% FBS, and 10 ul was added to 90 ul of each of the SmTrip10 peptide titrations. Samples were incubated for 30 minutes on an orbital shaker set to 500 rpm. 2 ml of detection reagent (OptiMEM+10% FBS+20 ul of 1M DTT+80 ul of 5 mM Furimazine) was prepared. 10 ul of detection reagent was added to each LgTrip 3546:peptide solution, and plates were placed on an orbital shaker. Plates were read at 5 minutes and 10 minutes. SmTrip10 pep86 (SmHiTrip; SEQ ID NO: 25) and SmTrip10 pep289 (SEQ ID NO: 150) were used as controls on each of the 4 plates. Results are depicted in the tables of FIGS. 82-83.

Example 56

Antares Constructs

Experiments were conducted during development of embodiments herein to demonstrate the complementation systems described herein in the context of the Antares BRET system comprising one or more CyOFP fluorescent proteins linked to a component of the systems described herein.

Figure 84:
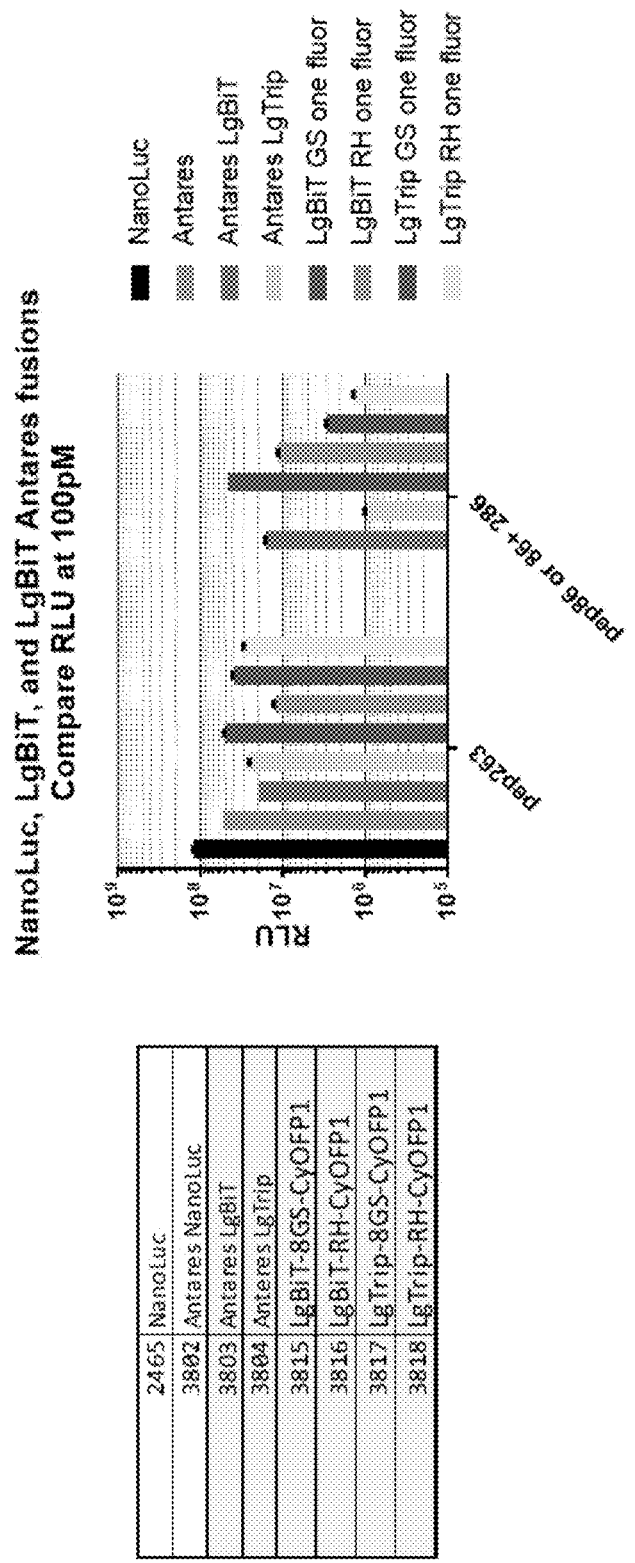
Figure 85A:
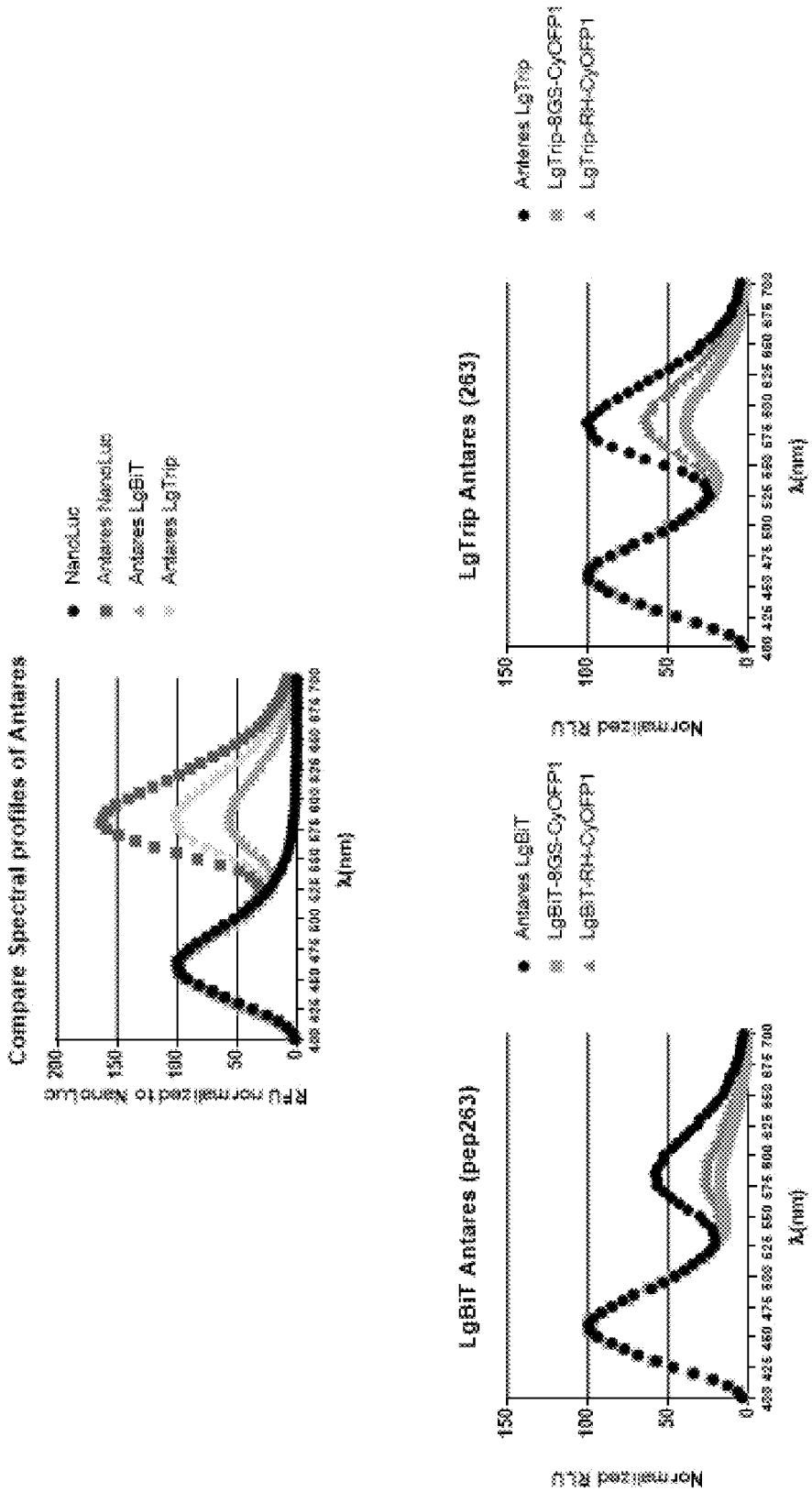
FIGS. 85A-B. Graphs depicting emission spectra from Antares-type fusions (LgTrip 3546) (SEQ ID NO: 51) with SmTrip9 pep263 (SEQ ID NO: 35) and SmTrip pep86 (HiBiT; SEQ ID NO: 25) or SmTrip10 pep86 (HiBiT; SEQ ID NO: 25)+SmTrip9 pep286 (SEQ ID NO: 37).
Figure 85B:
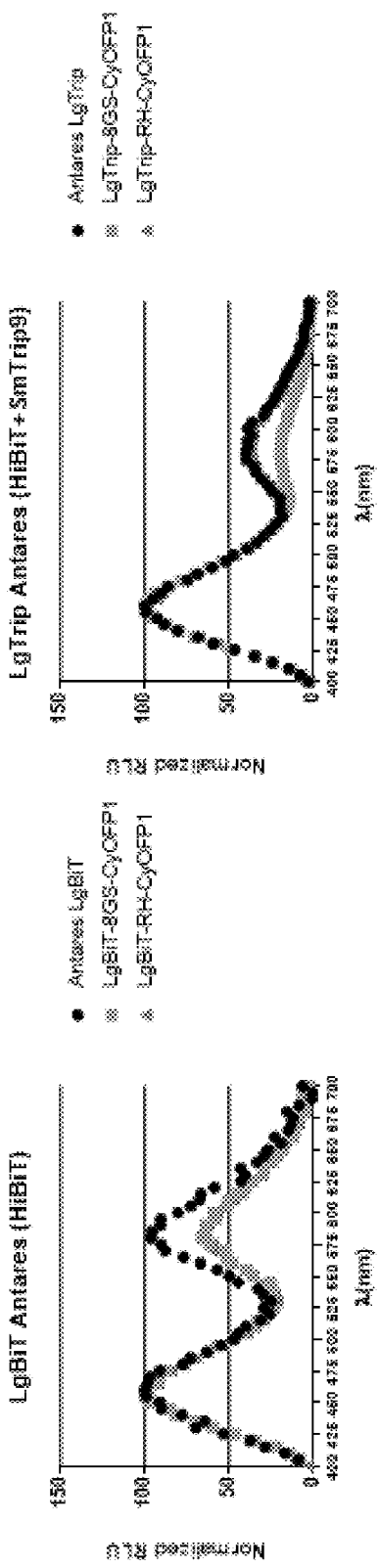

Samples were purified using HisLink Resin: 10 ml of 100 mM HEPES pH 7.5, 1 ml of FastBreak Cell Lysis Reagent and 50u of DNase were added, and samples were placed on rotating mixer for 45 minutes and then spun at 7,000 rpm for 20 minutes. Next, 1 ml of HisLink resin was added to each sample, and samples were washed 3× with 5 ml of binding wash buffer, eluted with 300 ul of elution buffer, and dialyzed against TBS (2 hours, TBS replace, 2 more hours). Samples were diluted to 100 nM in TBS+0.01% BSA and then further diluted to 0.4 nM by adding 4 ul to 996 ul of TBS+0.01% BSA. 3× serial dilutions were prepared by transferring 300 ul to 700 ul. 10 ml of 2 uM dipeptide pep263 (SEQ ID NO: 35) was prepared in TBS+0.01% BSA. 10 ml of 400 μM SmTrip10 pep86 (SEQ ID NO: 25) was prepared in TBS+0.01% BSA. 10 ml of 1 uM SmTrip9 pep286 (SEQ ID NO: 37) and 10 uM SmTrip10 pep86 were prepared. 50 ul of each enzyme was combined with either TBS or dipeptide solution (all samples in triplicate on two plates). Antares fusions with LgBiT and LgTrip 3546 samples were combined with SmTrip9 pep286+SmTrip10 pep86. Samples were incubated for 1 hour at RT. 100 ul of 20 um furimazine was added in TBS+0.01% BSA+2 mM ATT. Plates were incubated for 3 minutes and then read on GMM+. Results are depicted in graphs of FIGS. 84-85.

Example 57

"Dark" Dipeptide 272

Experiments were conducted during development of embodiments herein to compare titration series with "Dark" dipeptide 272 (SEQ ID NO: 146) with LgBiT (SEQ ID NO: 11) and LgTrip 3546 (SEQ ID NO: 51) in the presence of 0.1 nM pep 263. LgBiT and LgTrip 3456 were diluted to 200 nM in TBS+0.01% BSA and +/−0.4 nM of dipeptide pep263 (SEQ ID NO: 35) and incubated for 10 minutes. A 3× dilution series of dipeptide pep272 was prepared starting at 40 nM (at this concentration, LgBiT showed inhibition at high concentrations, so $K_d$ value could not be calculated; a new titration series was created starting at 4 nM pep272 for LgBiT to obtain a $K_d$ value). 50 ul of the peptide dilution series was added to an assay plate followed by addition of 50 ul of the LgBiT and LgTrip 3546 dilutions. Samples were incubated for 1 hour at room temperature. After addition of 100 ul of NanoGlo+50 uM Furimazine (Fz), plates were incubated for 5 minutes and luminescence was read on GMM+. Results are depicted in FIG. 86.

Example 58

Comparison of Dark Dipeptides Pep272 and Pep273

LgBiT (SEQ ID NO: 11) and LgTrip 3546 (SEQ ID NO: 51) were diluted to 200 nM in TBS+0.01% BSA with +/−0.4 nM of dipeptide pep263 (SEQ ID NO: 35) or +/−0.4 nM didpeptide pep264 (SEQ ID NO: 299) and incubated for 10 minutes. 3× dilution series of didpeptide pep272 (SEQ ID NO: 146) and dipeptide pep273 (SEQ ID NO: 298) were prepared starting at 40 nM using the dipeptide pep263 dilution as a diluent for pep272 and the dipeptide pep264 dilution as a diluent for pep273. 50 ul of the LgBiT and LgTrip 3546 dilutions was combined with 50 ul of the pep272/273 titration series and incubated at room temperature for 2 hours. After addition of 100 ul of NanoGlo® buffer+50 uM Fz, plates were incubated at room temperature for 5 minutes, and luminescence was read on GMM+. Results are depicted in FIG. 87.

Example 59

Darkbit Pep167

Figure 88:
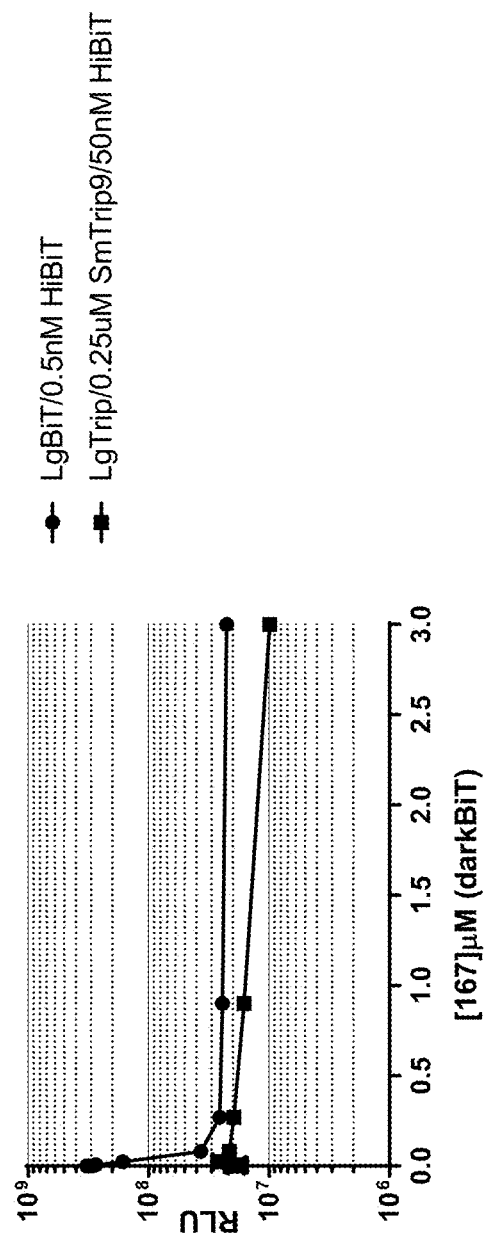
FIG. 88. Graph depicting inhibition of LgBiT (SEQ ID NO: 11) and LgTrip 3546 (SEQ ID NO: 51) with dark BiT167 (SEQ ID NO: 300).

Solutions with 200 nM LgBiT (SEQ ID NO: 11) and LgTrip 3546 (SEQ ID NO: 51) were prepared. 0.2 nM SmTrip10 pep86 (SmHiTrip; SEQ ID NO: 25) was added to LgBiT solutions, and 1 uM of SmTrip9 pep286 (SEQ ID NO: 37) with 200 nM of SmTrip10 pep86 was added to LgTrip 3546 solutions. A dark bit (pep167) (SEQ ID NO: 300) titration was prepared starting at 12 uM in TBS+0.01% BSA. 50 ul of the dark bit titration was combined with 50 ul of the LgBiT or LgTrip 3546/pep167 dilutions and incubated for 1 hour. After addition of 100 ul of NanoGlo® buffer+50 uM Furimazine (Fz), plates were incubated 10 minutes, and luminescence was read on GMM+. Results are depicted in FIG. 88.

Example 60

Figure 89:
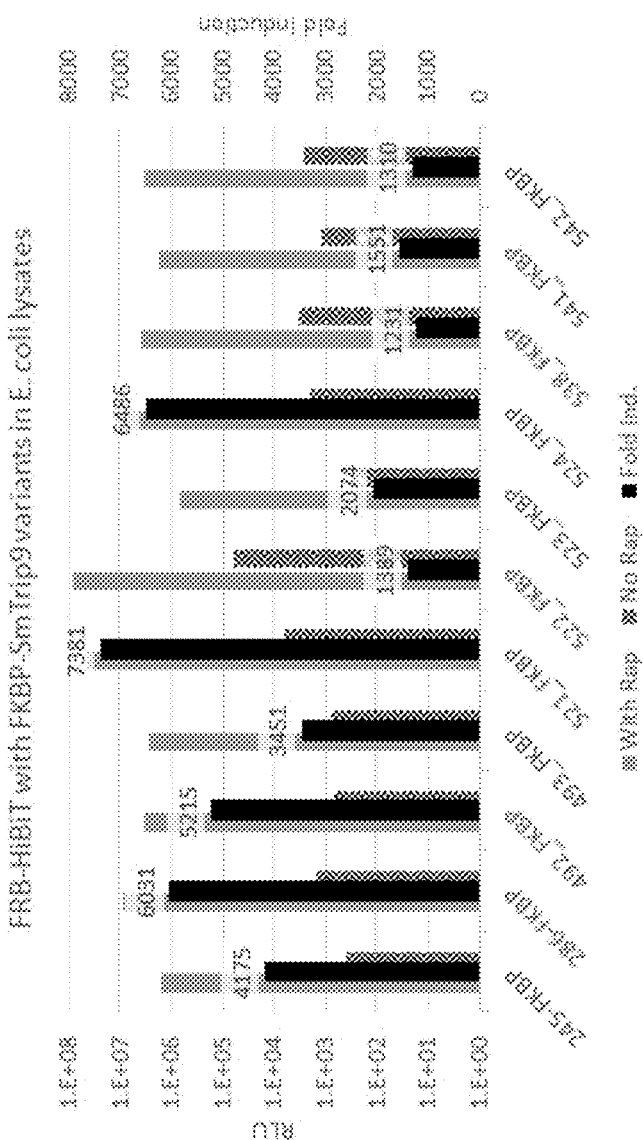
FIG. 89. Graph depicting FRB-FKBP facilitation of luminescent complex formation in E. coli lysate with FKBP-SmTrip9 pep434 (SEQ ID NO: 230) variants' complementation with LgTrip 3546 (SEQ ID NO: 51) and FRB-HiBiT (SEQ ID NO: 25).
Figure 90:
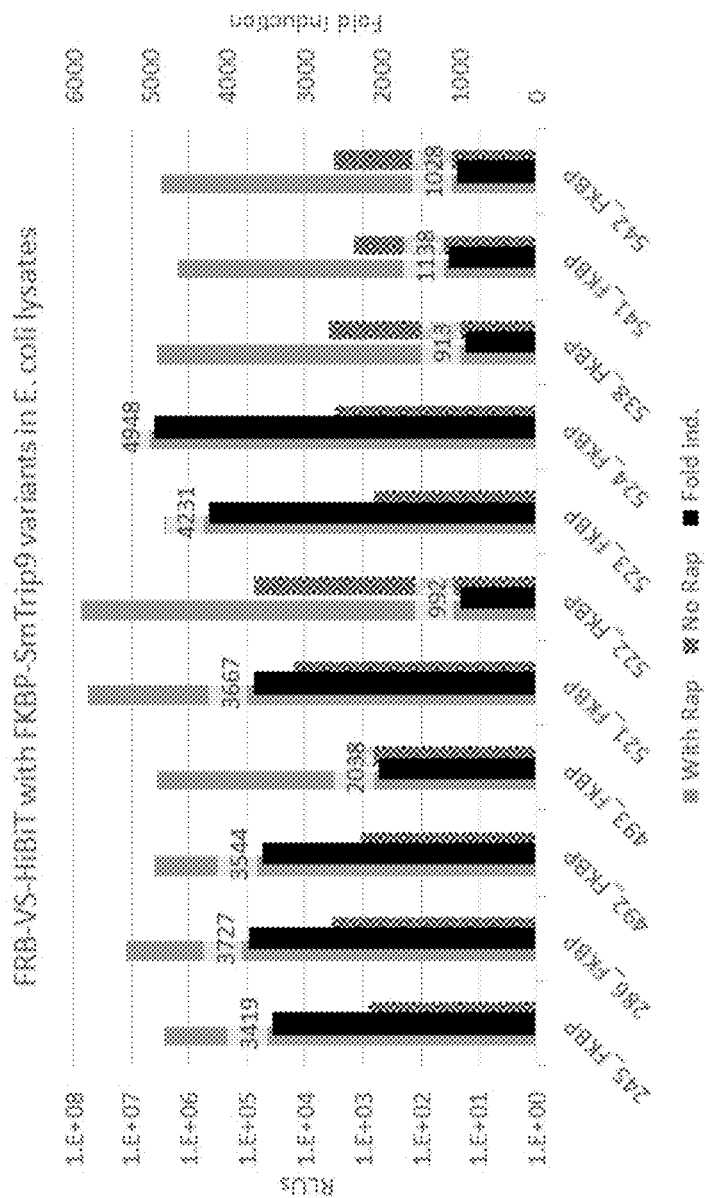
FIG. 90. Graph depicting FRB-FKBP facilitation of luminescent complex formation in E. coli lysate with SmTrip9 pep434 (SEQ ID NO: 230) variants' complementation with LgTrip 3546 (SEQ ID NO: 51) and FRB-SmTrip10 pep289 (VS-HiBiT; SEQ ID NO: 150).

FRB-FKBP Facilitated Complementation in *E. coli* Lysates with SmTrip9 Pep435/434 Variants Cultures were grown overnight in LB+100 ug/ml ampicillin from glycerol stocks, and cells were diluted 1:100 in LB+0.15% glucose+0.1% rhamnose+Amp. After 20 hr shaking at 25° C., cells were diluted 1:4 in PLB and incubated 15 min at room temperature to lyse. Lysates of SmTrip9/SmTrip10 peptide combinations of interest were mixed 1:1 vol:vol and diluted 1:5 in PLB+200 nM LgTrip 3546 (SEQ ID NO: 51) with or without 30 nM rapamycin. Samples were incubated for 30 minutes at room temperature and combined 1:1 (vol:vol) with NanoGlo® buffer containing 50 uM Furimazine. Luminescence was read at 5 minutes. Results are depicted in FIGS. 89-90.

Example 61

Figure 91A:
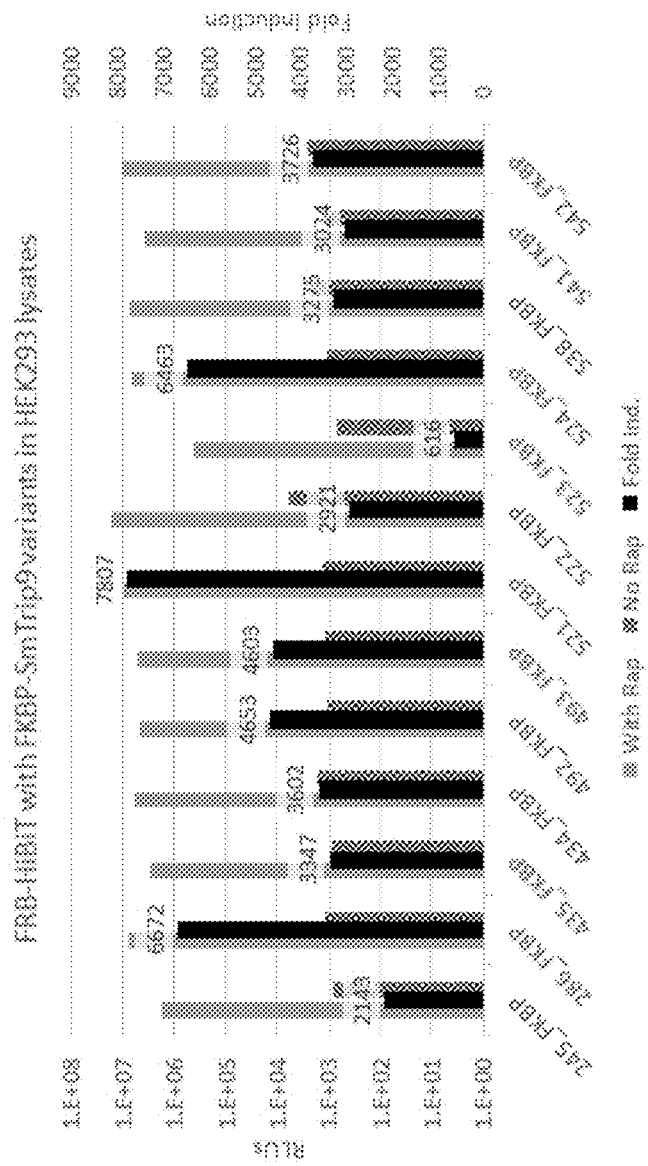
FIGS. 91A-B. (A) Graph depicting FRB-FKBP facilitation of luminescent complex. formation in HEK293 lysate with SmTrip9 pep435 (SEQ ID NO: 231) and SmTrip9 pep434 (SEQ ID NO: 230) variants' complementation with LgTrip 3546 (SEQ ID NO: 51) and FRB-SmTrip10 pep86 (HiBiT; SEQ ID NO: 25). (B) Graph depicting FRB-FKBP facilitation of luminescent complex formation in HEK293 lysate with SmTrip9 pep435 (SEQ ID NO: 231) and SmTrip9 pep434 (SEQ ID NO: 230) variants' complementation with LgTrip 3546 (SEQ ID NO: 51) and FRB-SmTrip10 pep289 (SEQ ID NO: 150).
Figure 91B:
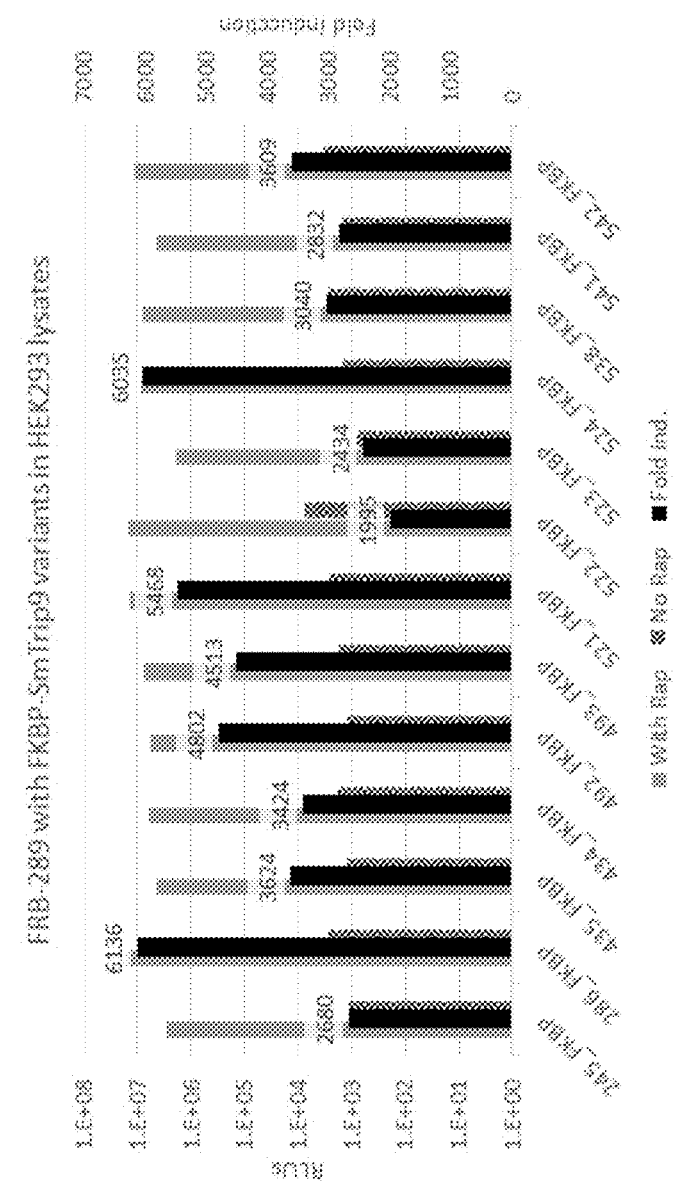

FRB-FKBP Facilitated Complementation
FRB-FKBP Facilitated Complementation in HEK Lysates with SmTrip9 Pep435 and Pep434 Variants 600,000 cells were added to each well of 6-well plates in DMEM+1% FBS. Cells were grown overnight at 37° C. with 5% $CO_2$ and transfected with 3 pg DNA (FKBP or FRB construct) per well using FuGENE protocol. Following overnight incubation at 37° C. with 5% $CO_2$, cells were washed with DPBS. After aspiration, 1 ml of fresh DPBS was added to each well and plates were frozen at −80° C. for ~10 min. Plates were thawed at room temperature to lyse cells and lysates were cleared by centrifuging 10 min and removing supernatant. Lysates were diluted 2-fold in PLB and SmTrip9/SmTrip10 peptide combinations of interest were mixed 1:1 (vol:vol). Mixtures were then diluted 1:5 in PLB+200 nM LgTrip 3546 (SEQ ID NO: 51) with or without 30 nM rapamycin. Samples were incubated for 30 minutes at room temperature and combined 1:1 vol:vol with NanoGlo® buffer containing 50 uM Furimazine. Luminescence was read at 5 minutes. Results are depicted in FIG. 91.

FRB-FKBP Assay Screen with SmTrip9 s 823 and 840

Cultures of FKBP_SmTrip9 variants and FRB-SmTrip10 s were grown overnight in LB+100 µg/ml ampicillin at 37° C. Cells were diluted 1:20 in LB with 0.15% glucose, 0.1% rhamnose, and 100 ug/ml ampicillin. Cultures were induced ~20 hr at 25° C. with shaking. PLB assay reagent was prepared with 444 nM LgTrip 3546, 90× diluted FRB-SmTrip10 culture, +/−35 nM Rapamycin. Ninety microliters of assay reagent was added to each well of 96-well assay plates. FKBP_SmTrip9 cultures were diluted 1:10 in PLB and 10 ul was added to assay plates. Samples were incubated 30 min at room temperature. One hundred microliters of NanoGlo containing 50 uM furimazine was added to assay plates wells and luminescence was read on GloMax® after 5 minutes. Results are depicted in FIG. 92.

Example 62

Determination of $K_d$ of Pep434 and Pep435 Variants

LgTrip 3546 (SEQ ID NO: 51) was diluted to 0.2 nM in TBS+0.01% BSA+0.01% Tergitol. 20 uM solutions of each SmTrip9-like peptides were prepared with 100 uM SmTrip10 pep86 (SEQ ID NO: 25) in TBS+0.01% BSA+ 0.01% Tergitol. 2-fold serial dilutions of each SmTrip9-like peptide were performed using the 100 uM SmTrip10 pep86 solution as a diluent. Peptide dilutions were combined with LgTrip 3546 solution 1:1 (vol:vol) and incubated 10 minutes. TBS+0.01% BSA+0.01% Tergitol+20 uM Furimazine (Fz) detection reagent was added to LgTrip/peptide solutions 1:1 vol:vol and luminescence was read at 10 min. Results are depicted in FIG. 93.

Example 63

Detection of CRISPR-Tagged Dipeptide-GAPDH Using LgTrip 3546

Experiments were conducted during development of embodiments herein to demonstrate that both LgTrip 2098 (SEQ ID NO: 31) and LgTrip 3546 (SEQ ID NO: 51) find use as bioluminescence reagents for detecting endogenously tagged GAPDH (Tagged with SmTrip10 pep86 (SmHiTrip; SEQ ID NO: 25).

HeLa cells were edited using CRISPR/Cas9 to express endogenous GAPDH C-terminal fusions to the indicated peptide. The edited HeLa cells were plated at a density of approximately 20,000 cells per well of a solid white assay plate in 100 µl of DMEM/10% FBS. Cells were then incubated in the presence of 100 µl of NanoGlo® HiBiT Lytic Buffer (Promega) containing NanoGlo® HiBiT Lytic Buffer and 200 nM of LgTrip for 10 min. Luminescence was recorded using a GloMax® Discover with 0.5 s integration time. Relative cell numbers were determined using the CellTiter® Glo Luminescent Cell Viability Assay (Promega) according to manufacturer's protocol. Data are represented as average relative light units normalized to cell number, with variability expressed as standard deviation.

Figure 94:
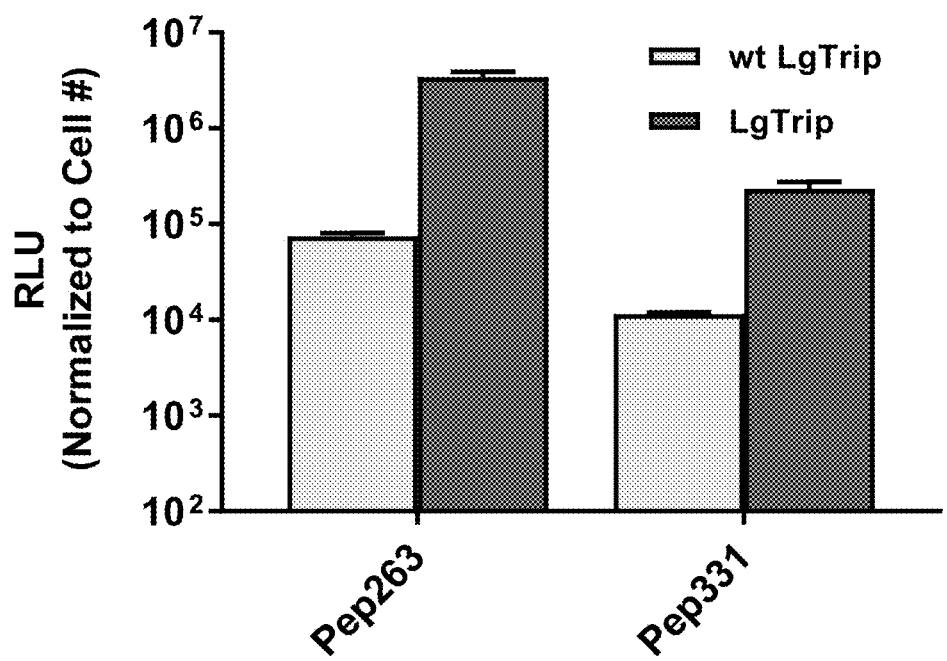
FIG. 94. Graph demonstration of wt LgTrip 2098 (SEQ ID NO: 31) and LgTrip 3546 (SEQ ID NO: 51) with pep263 (SEQ ID NO: 35) or pep331 (SEQ ID NO: 301) as bioluminescence reagents for detecting endogenously tagged (e.g., by CRISPR/Cas9) GAPDH.
Figure 95A:
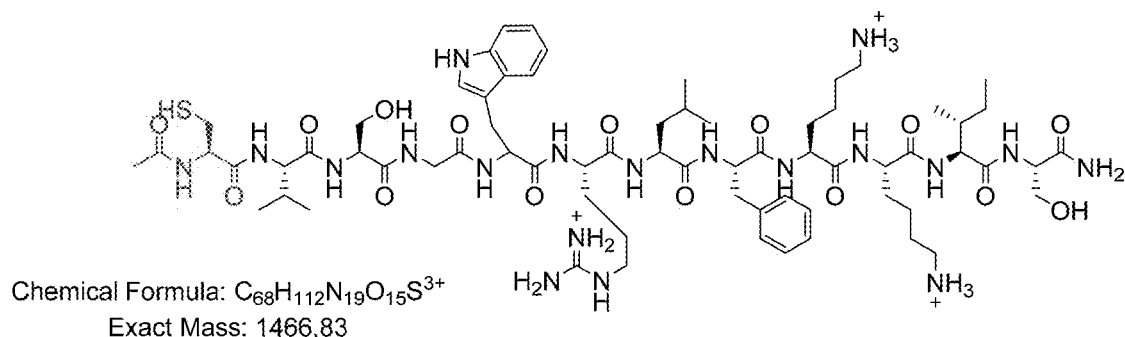
FIGS. 95A-E. Exemplary SmTrip10 chemical conjugates. (A) Example of SmTrip10 with N-terminal cysteine modification for disulfide bond formation on solvent exposed or protected cysteine targets on proteins/peptides/DNA and RNA oligonucleotides/small molecules or proteins/peptides/DNA and RNA oligonucleotides/small molecules that have been prepared with maleimide for reaction with a thiol such as cysteine or N-hydroxysuccinimide esters (NHS-ester) for reaction with an amine such as lysine. (B) Exemplary SmTrip10 with N-terminal azido-lysine modification for copper catalyzed or copper free 1,3-dipolar cycloaddition reactions ("Click") with unstrained or strained alkyne targets separately installed on proteins/peptides/DNA and RNA oligonucleotides/small molecules. (C) Exemplary SmTrip10 with N-terminal N-hydroxysuccinimide ester (NHS-ester) for general conjugation to nucleophiles (e.g., lysines, other primary amines) on proteins/peptides/DNA and RNA oligonucleotides/small molecules. Nucleophiles can be present on unmodified proteins/oligos/small molecules or may be chemically added for the purposes of this conjugation. (D) Exemplary SmTrip10 with an N-terminal propargyl glycine modification for copper catalyzed or copper free 1,3-dipolar cycloaddition reactions ("Click") with azide, diazo, or tetrazine targets separately introduced chemically or biologically on proteins/peptides/DNA and RNA oligonucleotides/ small molecules. (E) Exemplary SmTrip10 with a N-terminal propargyl glycine modification for copper catalyzed or copper free 1,3-dipolar cycloaddition reactions ("Click") and a C-terminal fluorophore (e.g., BODIPY dye).
Figure 95B:
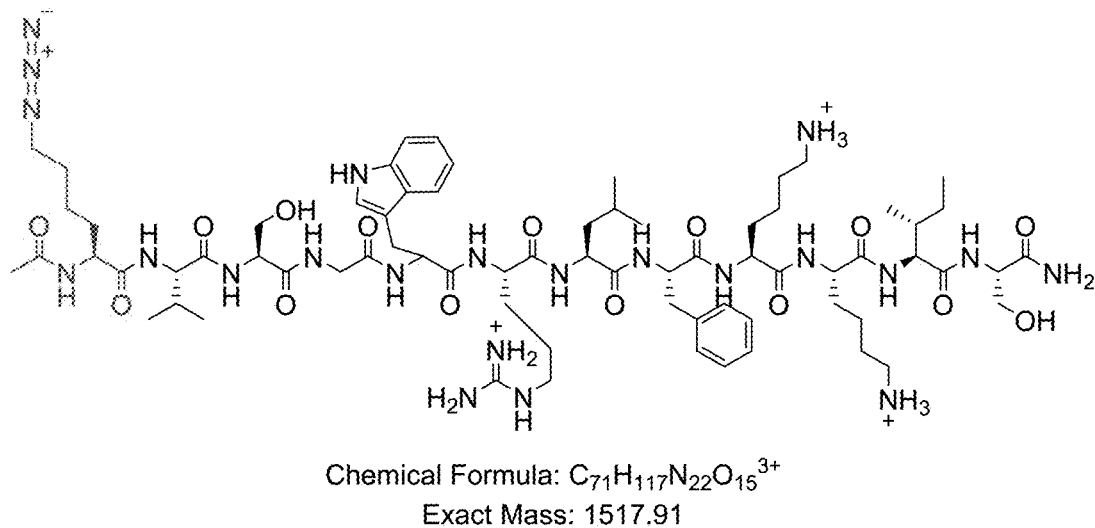
Figure 95C:
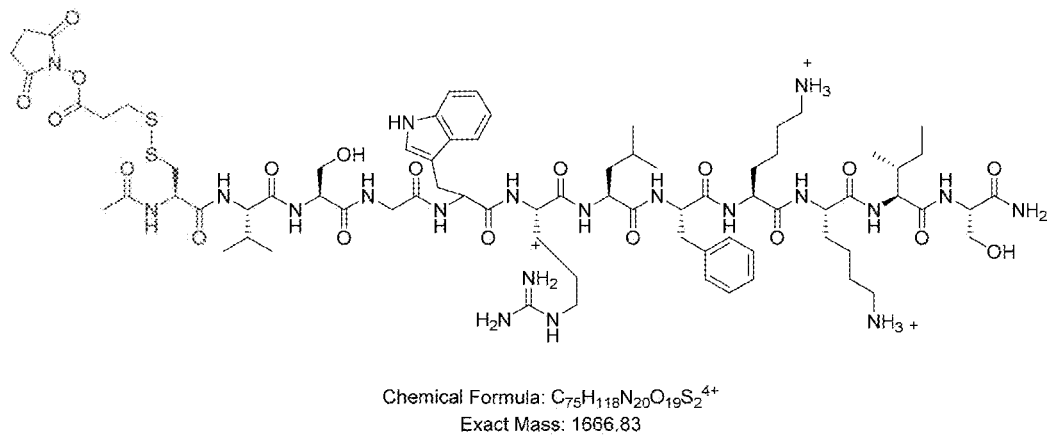
Figure 95D:
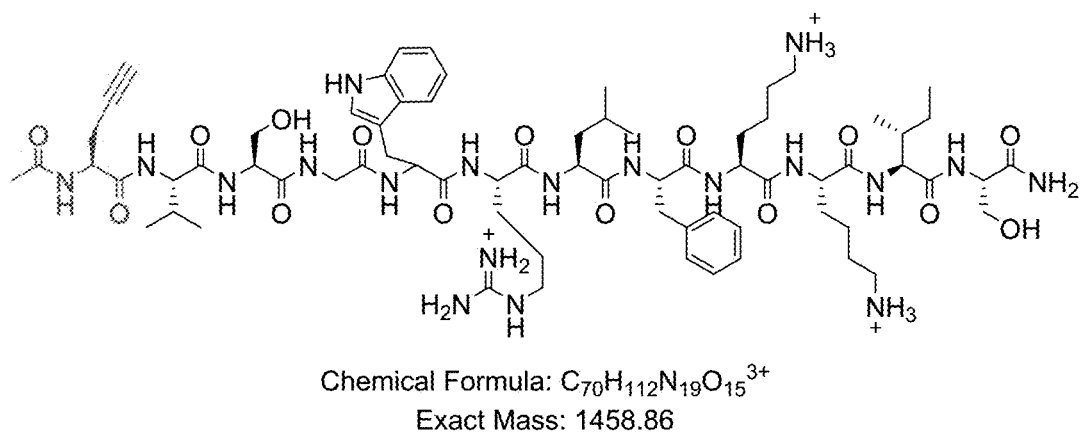
Figure 95E:
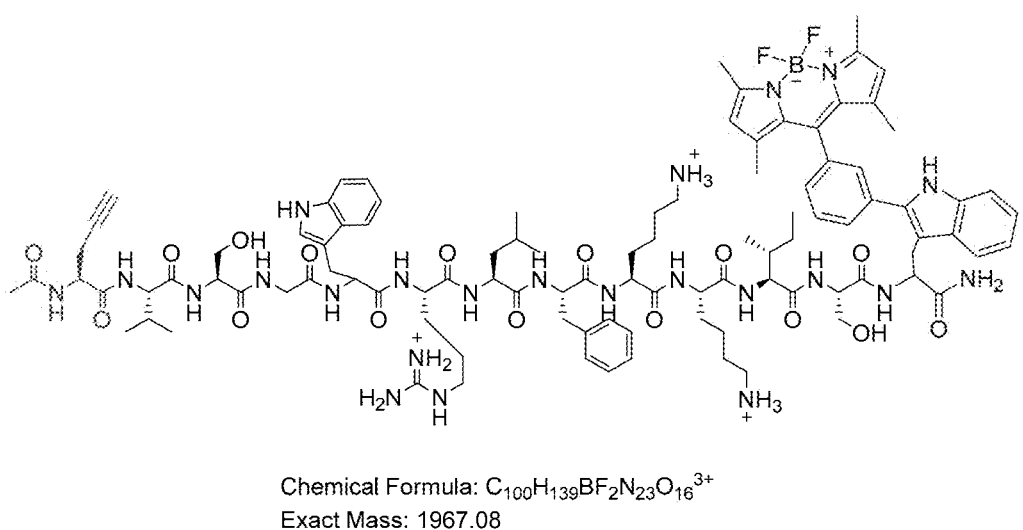
Figure 96A:
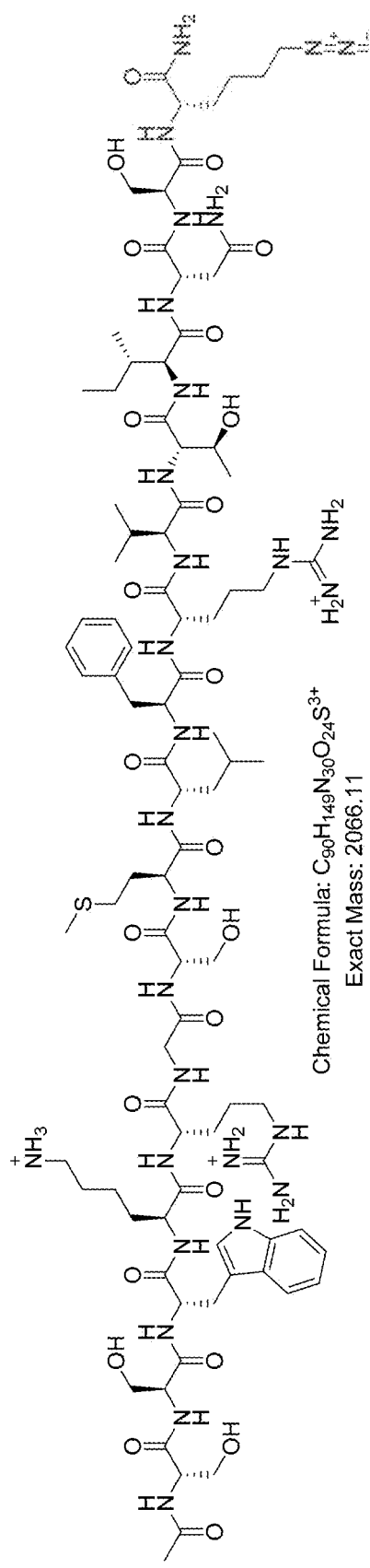
FIGS. 96A-F. Exemplary SmTrip9 pep286 chemical conjugates. (A) Example of SmTrip9-286 with C-terminal azido-lysine modification for copper catalyzed or copper free 1,3-dipolar cycloaddition reactions ("Click") with unstrained or strained alkyne targets separately introduced chemically or biologically on proteins/peptides/DNA and RNA oligonucleotides/small molecules. (B) Example of SmTrip9 pep286 with C-terminal propargyl glycine modification for copper catalyzed or copper free 1,3-dipolar cycloaddition reactions ("Click") with azide, diazo, tetrazine targets separately introduced chemically or biologically on proteins/peptides/DNA and RNA oligonucleotides/small molecules. (C) Example of SmTrip9 pep286 with C-terminal cysteine modification for disulfide bond formation on solvent exposed or protected cysteine targets on proteins/peptides/DNA and RNA oligonucleotides/small molecules or proteins/peptides/DNA and RNA oligonucleotides/small molecules that have been prepared with maleimide handles or N-hydroxysuccinimide esters. (D) Example of SmTrip9 pep286 with C-terminal cysteine modification and a N-terminal BODIPY dye. The dye is not limited to BODIPY and could be any fluorophore, BRET partner, or FRET dye/quencher partner. Dyes can be incorporated with any other combination of conjugation handles prepared on the C-terminus. (E) Example of SmTrip9 pep286 with C-terminal N-hydroxysuccinimide esters (NHS-ester) for general conjugation to nucleophilic targets (e.g., lysines) on proteins/peptides/DNA and RNA oligonucleotides/small molecules or proteins/peptides/DNA and RNA oligonucleotides/small molecules. (F) Example of SmTrip9 pep286 with C-terminal N-hydroxysuccinimide ester (NHS-ester) for general conjugation to nucleophilic targets (i.e. lysines) on proteins/peptides/DNA and RNA oligonucleotides/small molecules or proteins/peptides/DNA and RNA oligonucleotides/small molecules.
Figure 96B:
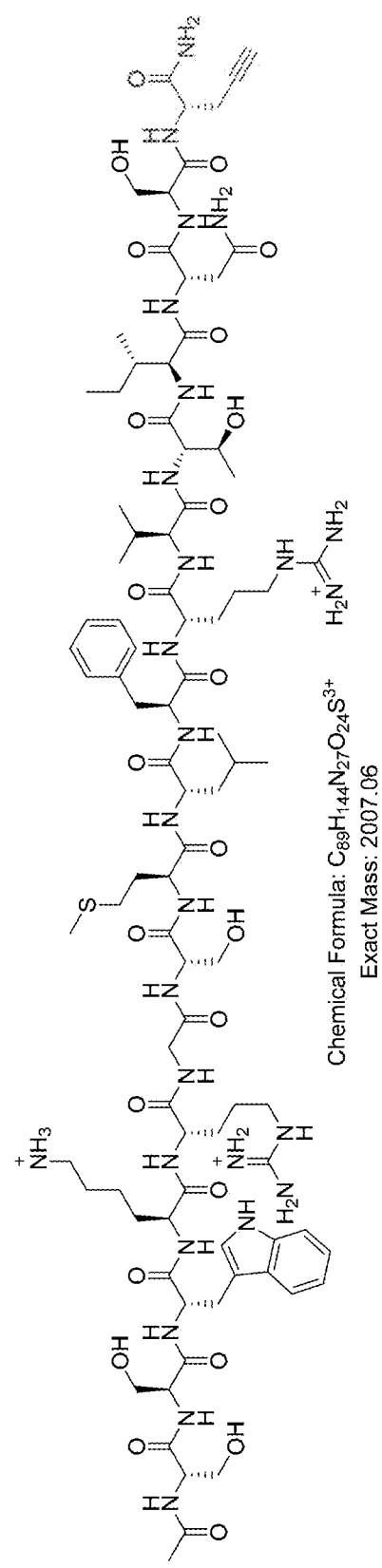
Figure 96C:
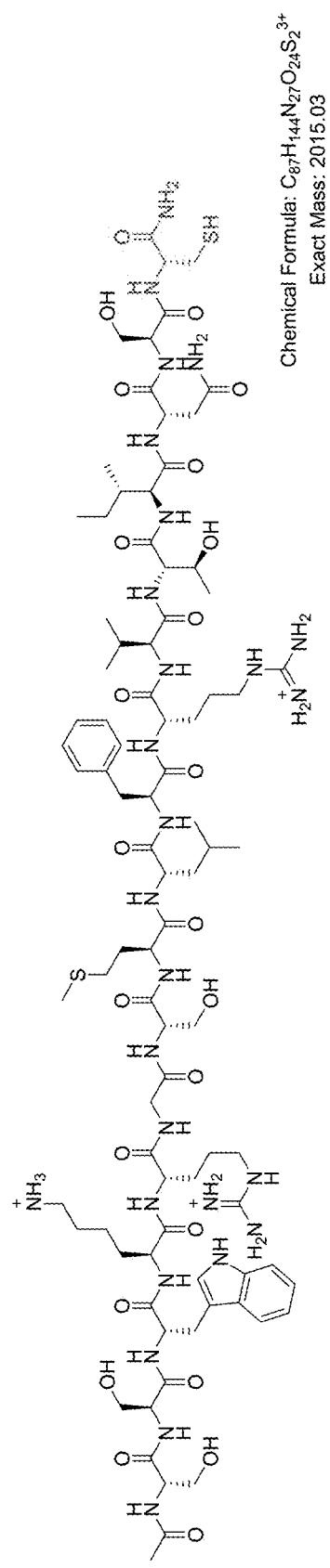
Figure 96D:
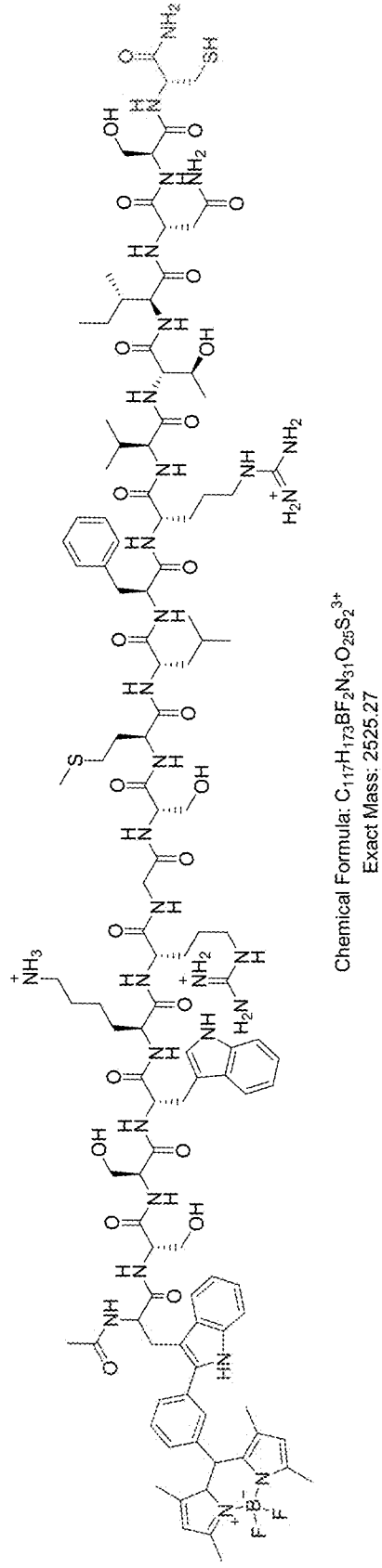
Figure 96E:
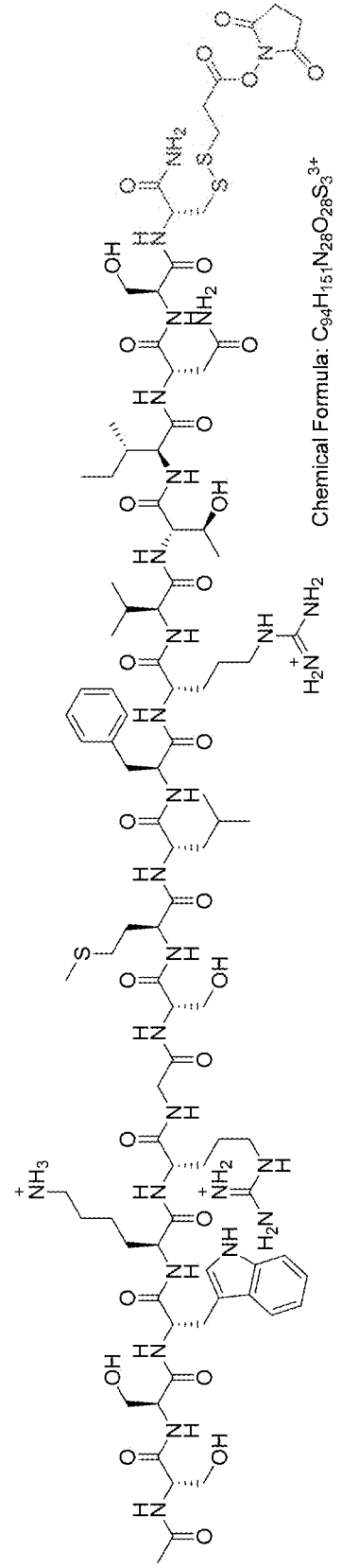
Figure 96F:
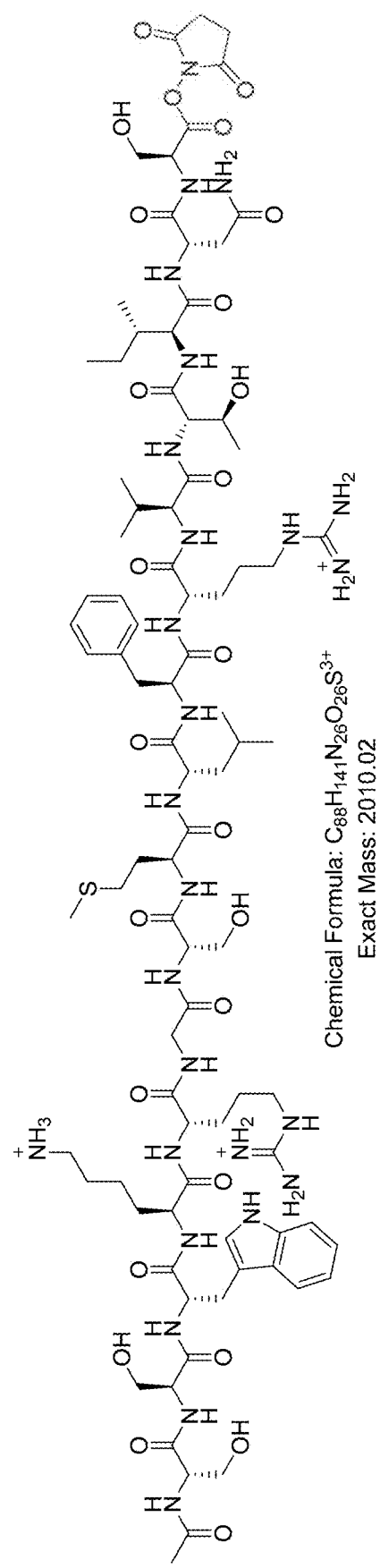
Figure 97A:
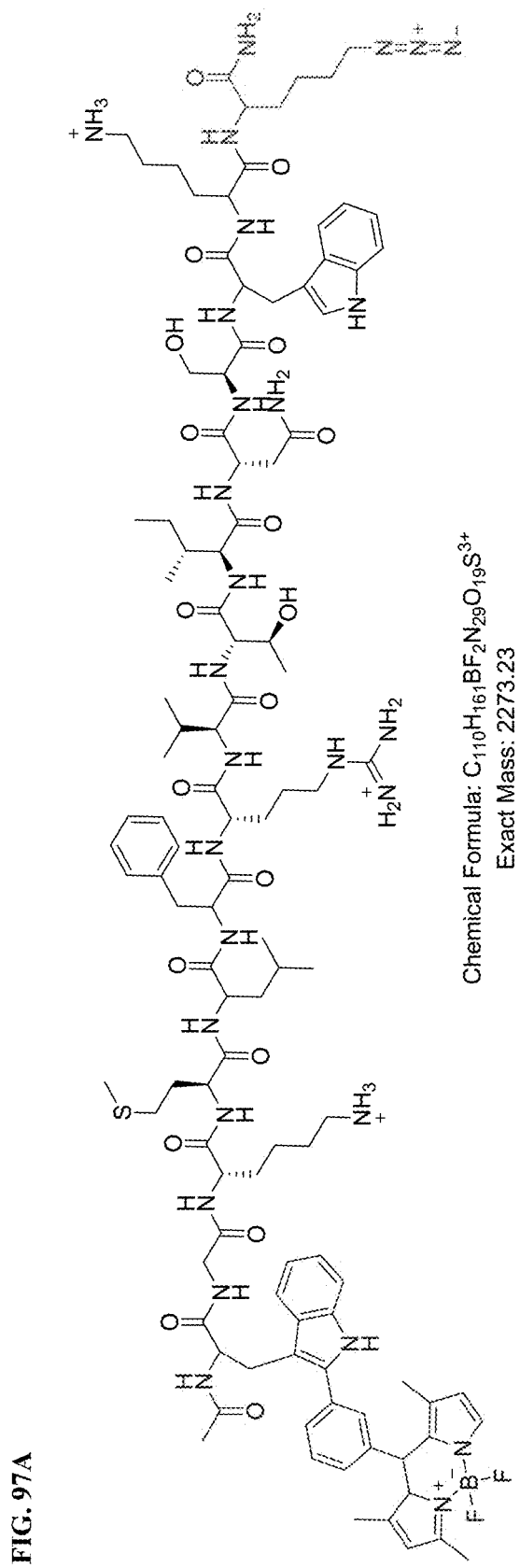
FIGS. 97A-F. Exemplary SmTrip9 pep521 chemical conjugates. (A) Example of SmTrip9 pep521 with C-terminal azido-lysine modification and a N-terminal BODIPY dye. The dye is not limited to BODIPY and could be any fluorophore, BRET partner, or FRET dye/quencher partner. Dyes can be incorporated with any other combination of conjugation handles prepared on the C-terminus. (B) Example of SmTrip9 pep521with C-terminal azido-lysine modification for copper catalyzed or copper free 1,3-dipolar cycloaddition reactions ("Click") with unstrained or strained alkyne targets separately introducedchemically or biologically on proteins/peptides/DNA and RNA oligonucleotides/ small molecules. (C) Example of SmTrip9 pep521 with C-terminal propargyl glycine modification for copper catalyzed or copper free 1,3-dipolar cycloaddition reactions ("Click") with azide, diazo, tetrazine targets separately introduced chemically or biologicallyon proteins/peptides/ DNA and RNA oligonucleotides/small molecules. (D) Example of SmTrip9 pep521 with C-terminal cysteine modification for disulfide bond formation on solvent exposed or protected cysteine targets on proteins/peptides/ DNA and RNA oligonucleotides/small molecules or proteins/peptides/DNA and RNA oligonucleotides/small molecules that have been prepared with maleimide handles or an NHS-ester. (E) Example of SmTrip9 pep521 with C-terminal N-hydroxysuccinimide ester (NHS-ester) for general conjugation to nucleophilic targets (i.e. lysines) on proteins/ peptides/DNA and RNA oligonucleotides/small molecules. (F) Example of SmTrip9 pep521 with C-terminal N-hydroxysuccinimide ester (NHS-ester) for general conjugation to nucleophilic targets (i.e. lysines) on proteins/peptides/DNA and RNA oligonucleotides/small molecules.
Figure 97B:
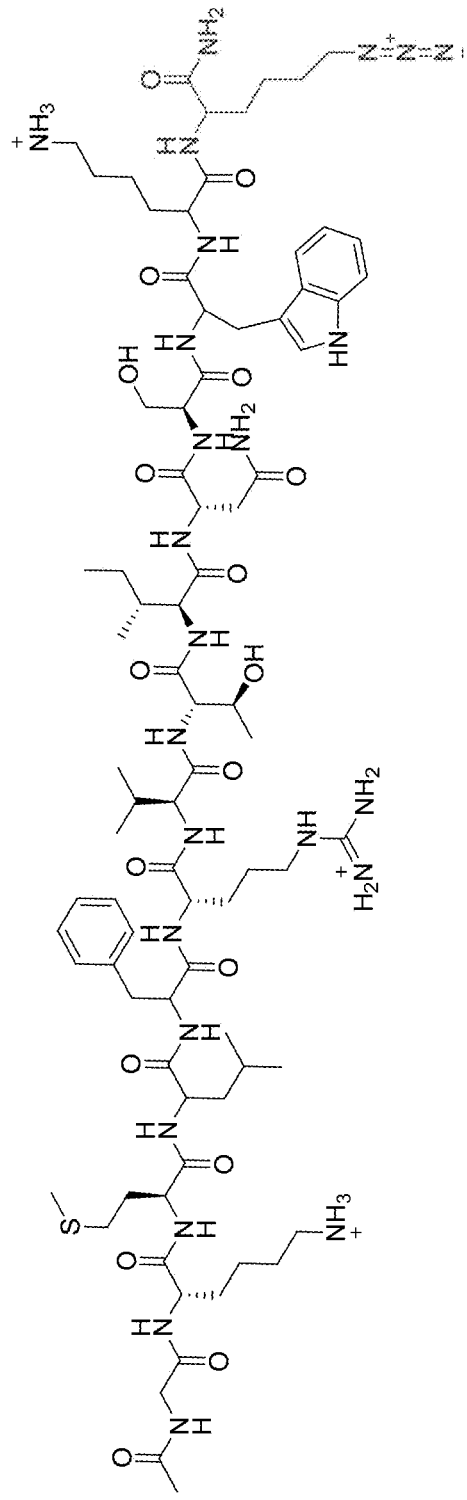
Figure 97C:
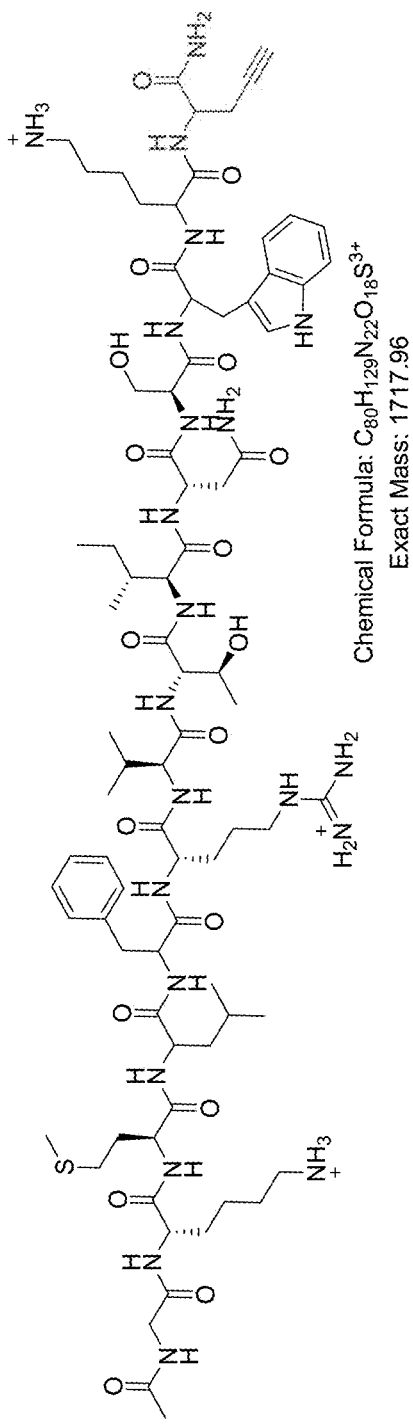
Figure 97D:
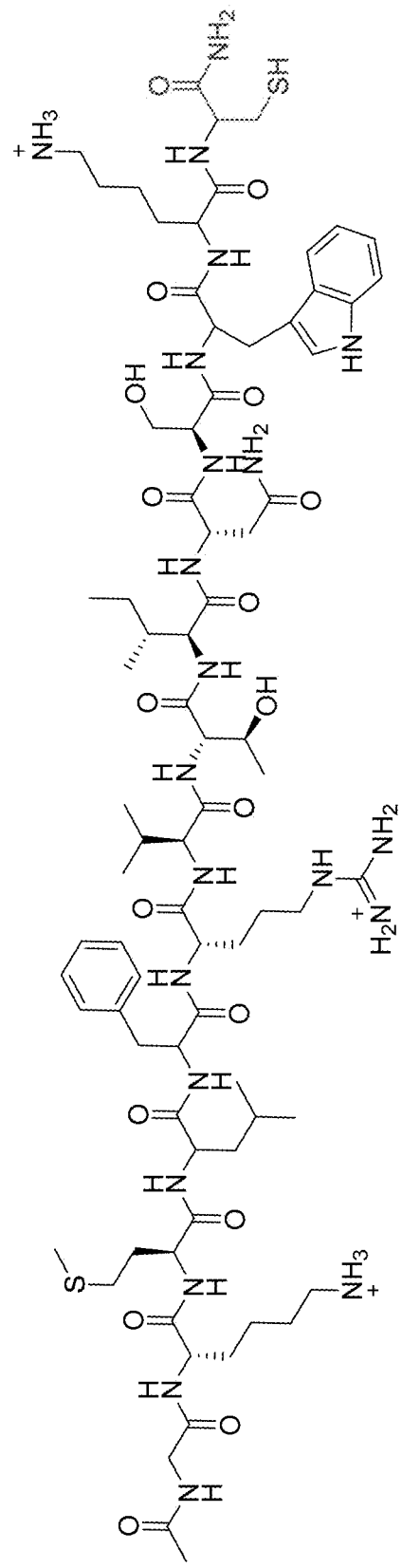
Figures 97E, 97F:
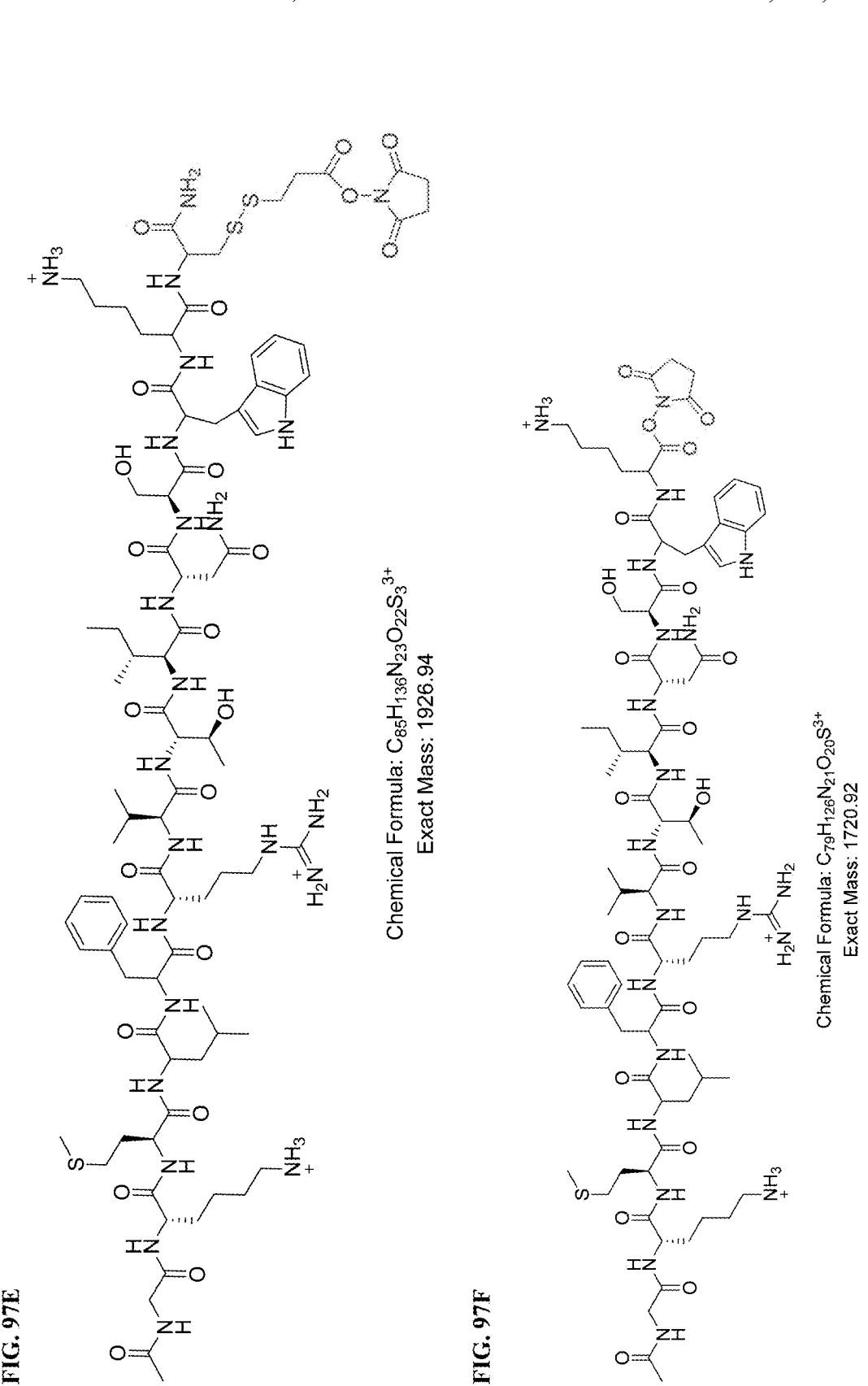
Figure 98C:
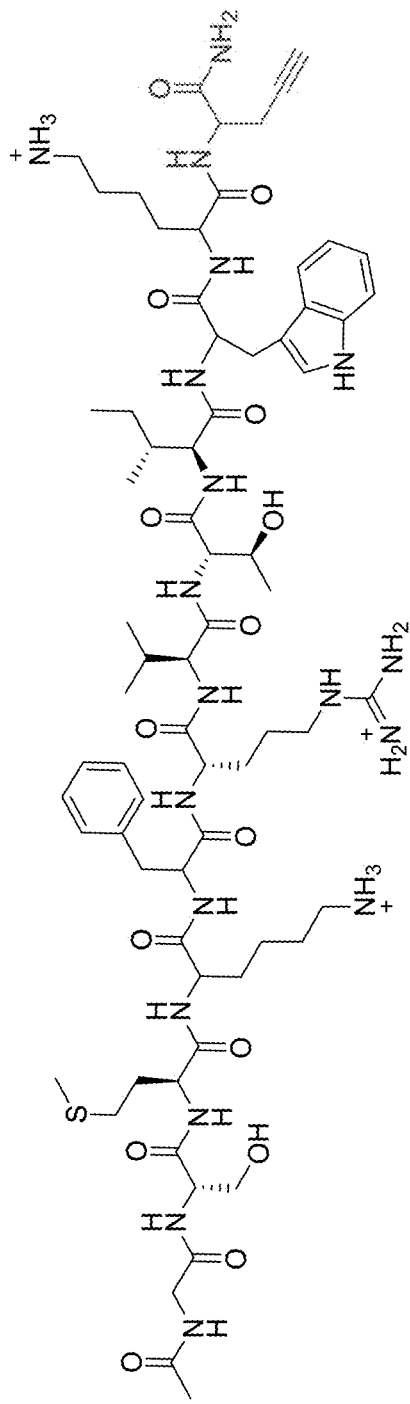
Figure 98D:
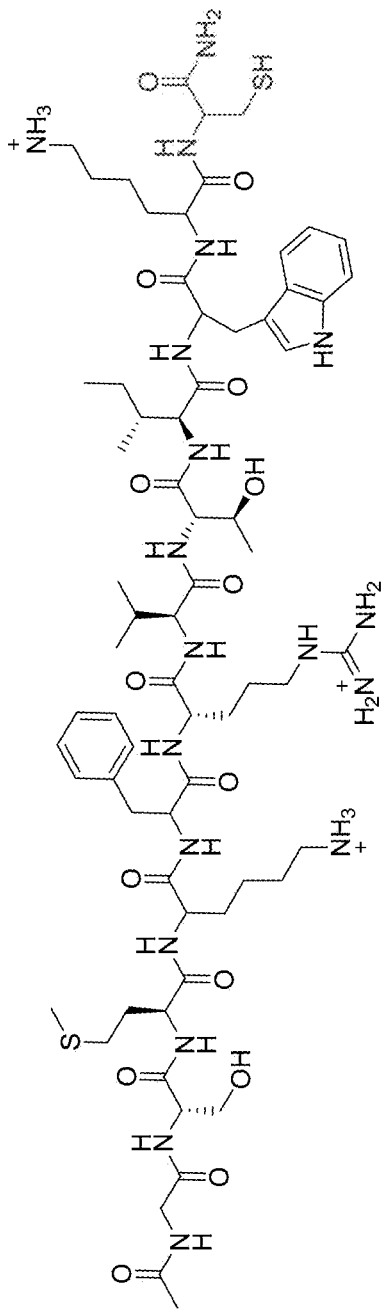
Figure 98E:
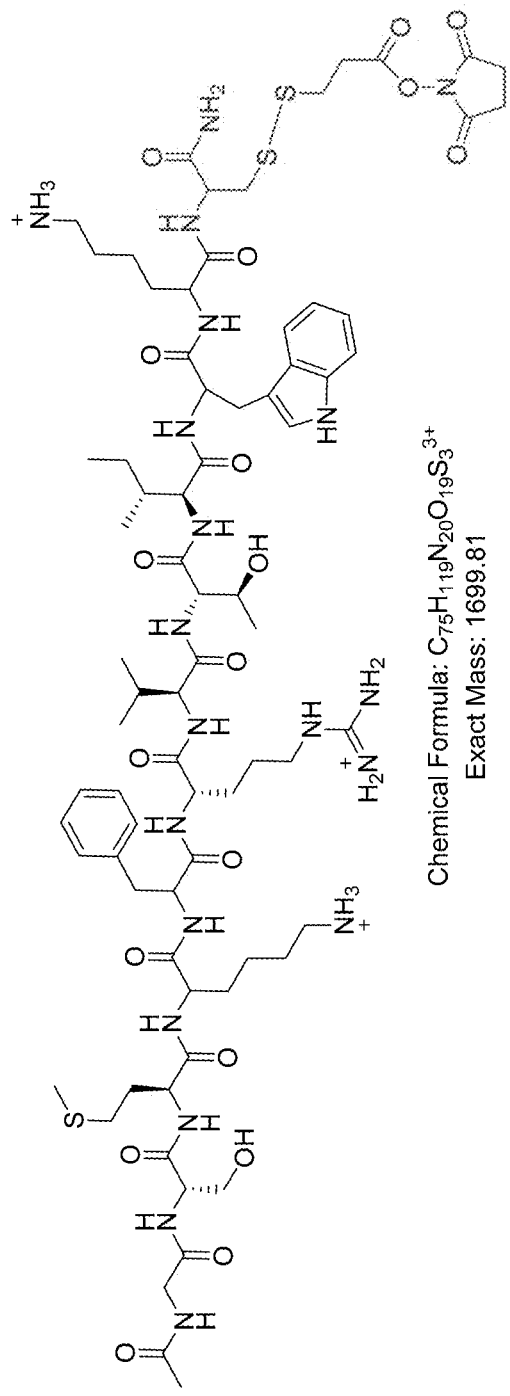
Figure 98F:
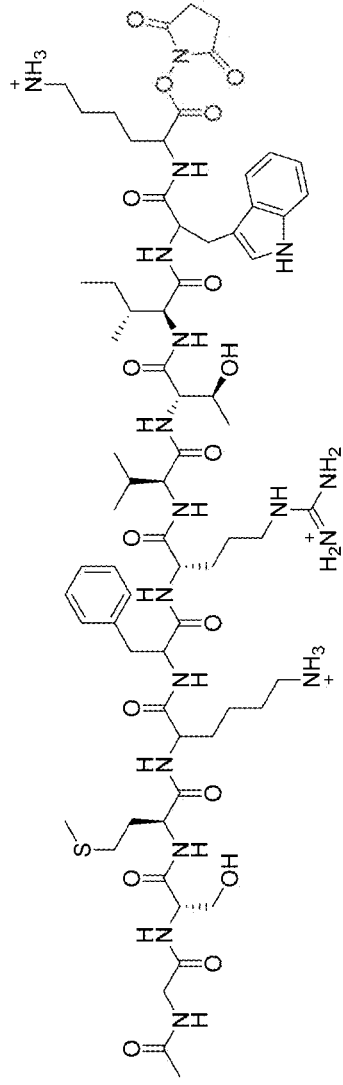

Results are depicted in FIG. 94.

Example 64

Site-Saturation Screen of SmTrip9

Experiments were conducted during development of embodiments herein to identify beneficial amino acid substitutions in SmTrip9.

Genetic site-saturation libraries were generated using primers with randomized codons at the indicated positions in SmTrip9. KRX *E. coli* was transformed with pooled genetic variants, plated onto LB+ampicillin agar, and grown overnight at 37° C. Individual colonies were picked and placed into 96-well culture plates containing LB+100 µg/ml ampicillin. Cultures were grown overnight at 37° C. with shaking. Cells were diluted 1:20 in LB with 0.15% glucose, 0.1% rhamnose, and 100 ug/ml ampicillin. Cultures were induced ~20 hr at 25° C. with shaking. Assay reagent was prepared by adding 444 nM LgTrip (SEQ ID NO: 51), 90× diluted FRB—VS-HiBiT culture, and +/−35 nM rapamycin to 25 mM HEPES with 0.3× Passive Lysis Buffer (PLB) and DNase. Ninety microliters of assay reagent was added to each well of 96-well assay plates. FKBP_SmTrip9 cultures were diluted 1:10 in PLB, and 10 ul was added to assay plates. Samples were incubated 30 min at room temperature. One hundred microliters of NanoGlo® buffer containing 50 uM furimazine was added to assay plates wells, and luminescence was read on GloMax® luminometer after 5 minutes.

Results are depicted in FIGS. 100-112.

Example 65

FRB-FKBP Facilitated Complementation in *E. coli* Lysates with SmTrip9 Pep435/434 Variants Cultures of FKBP_SmTrip9 variants and FRB-SmTrip10 s were grown overnight in LB+100 µg/ml ampicillin at 37° C. Cells were diluted 1:20 in LB with 0.15% glucose, 0.1% rhamnose, and 100 ug/ml ampicillin. Cultures were induced ~20 hr at 25° C. with shaking. Cultures were diluted 1:4 in PLB and incubated 15 min at room temperature to lyse cells. SmTrip9 and SmTrip10 dilutions were mixed 1:1 (vol:vol) for combinations of interest. Mixtures were diluted 1:5 into PLB+200 nM LgTrip, with or without 30 nM rapamycin. Samples were incubated 30 min at room temperature. Fifty microliters of NanoGlo® buffer containing 50 uM furimazine was added to assay plates wells, and luminescence was read on GloMax® luminometer after 5 minutes. Results are depicted in FIGS. 113-115.

Example 66

FRB-FKBP Facilitated Complementation Assay Screen with Combinational SmTrip9 Variants Cultures of FKBP_SmTrip9 variants and FRB-SmTrip10 s were grown overnight in LB+100 µg/ml ampicillin at 37° C. Cells were diluted 1:20 in LB with 0.15% glucose, 0.1% rhamnose, and 100 ug/ml ampicillin. Cultures were induced ~20 hr at 25° C. with shaking. PLB assay reagent was prepared with 444 nM LgTrip, 90× diluted FRB-SmTrip10 culture, +/−35 nM Rapamycin. Ninety microliters of assay reagent was added to each well of 96-well assay plates. FKBP_SmTrip9 cultures were diluted 1:10 in PLB, and 10 ul was added to assay plates. Samples were incubated 30 min at room temperature. One hundred microliters of Nano-Glo® buffer containing 50 uM furimazine was added to assay plates wells, and luminescence was read on GloMax® luminometer after 5 minutes. Results are depicted in FIGS. 116-122.

Example 67

Determination of Kd and Bmax of SmTrip9 Synthetic Peptides

LgTrip was diluted to 0.2 nM in TBS+0.01% BSA+0.01% Tergitol and pep289 was added to 25 uM. This solution was used as the diluent for 5-fold serial dilution series of SmTrip9 peptides. Samples were equilibrated 10 min at room temperature and aliquoted into assay plates in triplicate. TBS+0.01% BSA+0.01% Tergitol containing 20 uM furimazine was added to samples in 1:1 vol:vol ratio. Plates were incubated 10 min, and luminescence was read. To determine VS-HiBiT Kd, the same protocol was followed, but with saturating SmTrip9 (25 uM) and titration of VS-HiBiT. Results are depicted in FIGS. 123-130.

Example 68

Determination of Solubility of Synthetic SmTrip9 Peptides

Synthetic peptides were ordered from Peptide2.0 with termini blocked (N-terminal acetylation and C-terminal amidation) unless otherwise noted. Peptides were dissolved in nuclease-free water and stored at −20° C. Stocks were thawed in 22° C. water bath, centrifuged, and kept at 4° C. until use. Results are depicted in FIGS. 131.

Example 69

Biochemical Co-Titration of SmTrip9 Synthetic Peptides and Pep289

LgTrip was diluted to 200 nM in 25 mM HEPES with 0.3× Passive Lysis Buffer (PLB) and DNase. SmTrip9 peptides and pep289 were diluted to 100 uM and co-titrated serially 6-fold in PLB. Samples were incubated 10 minutes at room temperature. Most concentrated samples were diluted 50-100-fold in PLB. Samples were aliquoted in triplicate into assay plates and mixed 1:1 vol:vol with NanoGlo® buffer+50 uM furimazine. Luminescence was read after 10 minutes on ClarioStar or GloMax® instruments. Results are depicted in FIGS. 132-133.

Example 70

Biochemical Co-Titration of SmTrip9 and SmTrip 10 Synthetic Peptides

LgTrip was diluted to 200 nM in 25 mM HEPES with 0.3× Passive Lysis Buffer (PLB) and DNase. SmTrip9 and SmTrip10 peptides were diluted to 100 uM and co-titrated serially 6-fold in PLB. Samples were incubated 10 minutes at room temperature. Most concentrated samples were diluted 50-100-fold in PLB. Samples were aliquoted in triplicate into assay plates and mixed 1:1 vol:vol with NanoGlo® buffer+50 uM furimazine. Luminescence was read after 10 minutes on ClarioStar or GloMax® instruments. Results are depicted in FIG. 134.

Example 71

Biochemical Co-Titration of Pep521 and Alternative SmTrip 10 Synthetic Peptides

LgTrip was diluted to 200 nM in 25 mM HEPES with 0.3× Passive Lysis Buffer (PLB) and DNase. SmTrip10 peptides and pep521 were diluted to 100 uM and co-titrated serially 6-fold in PLB. Samples were incubated 10 minutes at room temperature. Most concentrated samples were diluted 50-100-fold in PLB. Samples were aliquoted in triplicate into assay plates and mixed 1:1 vol:vol with NanoGlo® buffer+50 uM furimazine. Luminescence was read after 10 minutes on ClarioStar or GloMax® instruments. Results are depicted in FIG. 135.

Example 72

Strand Removal (Purification) from LgTrip 3546 Template

A single colony from each clone was grown for 18 hours at 37° C. in LB+100 ug/ml ampicillin. The overnight culture was diluted 1:100 into 50 ml of Terrific Broth+0.1% Rhamnose+100 ug/ml ampicillin. After 48 hours of growth at 15° C., cells were pelleted and resuspended in 10 ml of 100 mM HEPES pH 7.5+0.001U/ml DNase. 1 ml of FastBreak® Lysis Buffer was added to each sample, and then samples incubated on a rotating mixer at 4° C. for 1 hour. A cleared lysate was prepared by centrifugation of 7,000 RPM for 10 minutes.

Purification of the strands using the MagneHis purification system: 300 ul µl of MagneHis resin (Promega) was added to each sample, and then samples mixed 20 times and placed on a magnetic stand. The supernatant was removed, and the resin was washed two times with column wash buffer. Samples were eluted in 600 ul of elution buffer. Samples were then placed in a dialysis apparatus to exchange with TBS. Identification of the strand removal proteins was observed via SDS PAGE as depicted in FIG. 136.

Example 73

Strand Removal Proteins with Various Combinations of Peptides

200 µl of OptiMEM+10% FBS was added to multiple wells of a multi-well plate. Peptide combinations were added to a final concentration of 10 µM with each to be assayed separately with each strand removal protein. Each strand removal protein was diluted to 20 nM (2 nM for LgTrip 3546) in OptiMEM+10% FBS. 20 µl of each strand removal peptide was added to the designated peptide combination, samples e mixed, and 45 µl aliquoted in triplicate into wells of a white assay plate (Costar 3600). After 15-minute incubation at RT, 5 µl of detection reagent (100 uM Fz (Promega LCS N205)) was added to each sample. Samples were placed on an orbital shaker for 30 seconds, and then luminescence was measured every 2 minutes for 1 hour. Luminescence is reported as peak height of the kinetic read. Background is OptiMEM+10% FBS+detection reagent.

As demonstrated in FIG. 137, there was no signal over background for strand removal proteins 7, 8, 9, 10 when added as separate peptides. Two of the three peptide combinations gave ~2× signal over background ((8+9) dipeptide+7+10) or ((7+8)dipeptide+9+10). One of the 3 peptide combinations gave ~10× signal over background (((9+10) dipeptide+7+8) The two dipeptide combination of (10+9)+ (7+8) gave signal of ~4.5 logs over background. It is likely that the peptide combinations that gave the greatest signal have the highest affinity. Lower affinity combinations could produce light in a facilitated complementation assay. FIG. 137D demonstrates that peptides with alternative split sites (e.g., mid beta strand) are capable of forming a bioluminescent complex.

Example 74

Strands 6, 7, 8, 9, or 10 Removal (Purification) from LgTrip 3546 Template

400 µl of OptiMEM+10% FBS was added to multiple wells of a deep well 96-well plate. Peptide combinations were added to a final concentration of 10 µM each peptide to be assayed separately with either ATG-3929 or LgTrip. The peptide solutions were then divided. To one of the peptide aliquots, 20 ul of either 20 nM ATG-3929 or 2 nM LgTrip was added to the designated peptide combination, samples mixed, and 45 µl of the +/−peptide samples aliquoted in triplicate into wells of a white assay plate (Costar 3600). After a 15-minute incubation at RT, 5 µl of detection reagent (100 uM Fz in OptiMEM+10% FBS (Promega LCS N205)) was added to each sample. Samples were placed on an orbital shaker for 5 minutes. Background for each sample is OptiMEM+10% FBS+peptide dilutions+detection reagent.

As demonstrated in FIG. 138, sample ATG-3929 with strands (9+10)+(7+8)+6 shows ~2× signal over background. On the other hand, the sample with two peptides (6+7+8)+ (9+10) showed ~300× over background.

Note that spontaneous complementation is not visible for samples with more than 3 peptides. It is possible that the affinity is not high enough affinity of the peptides is not high enough to produce light. It is possible that if the peptides are brought together through facilitated complementation with a fusion partner that it would be possible to obtain signal.

Example 75

Dipeptide Titrations

Figure 139A:
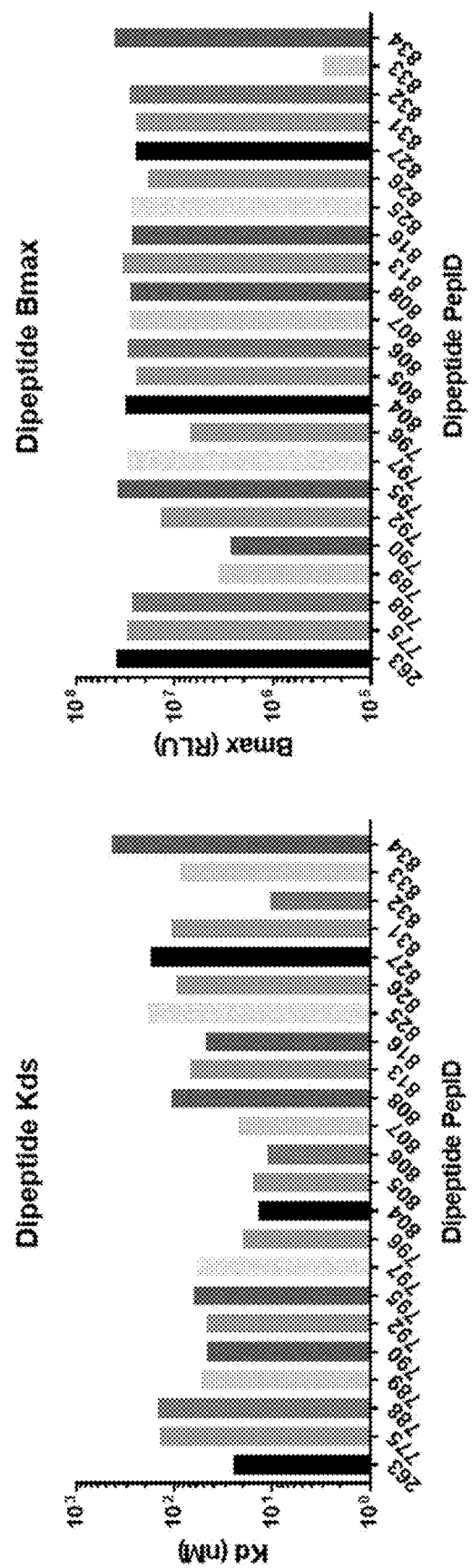
Figure 139C:
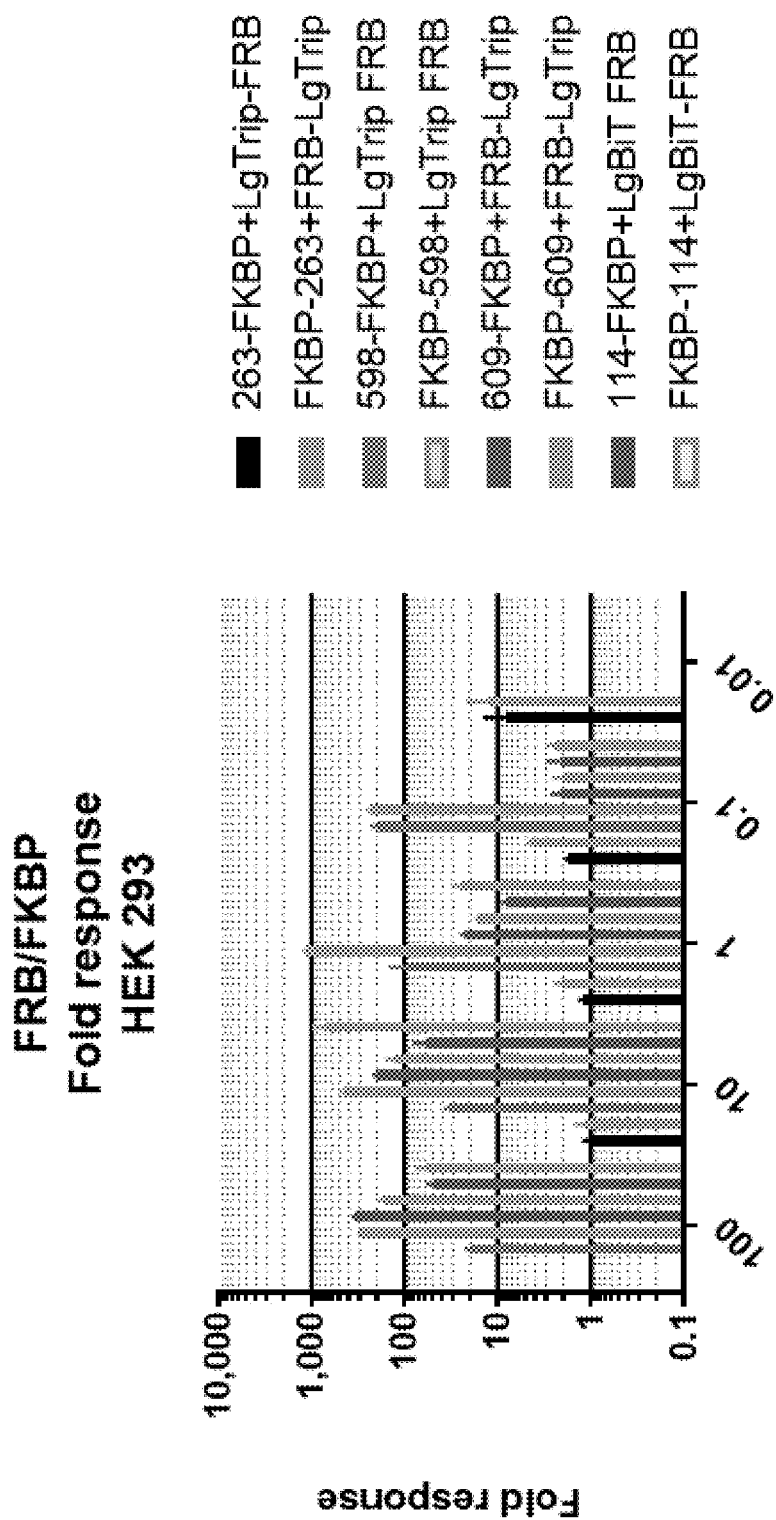
Figure 139D:
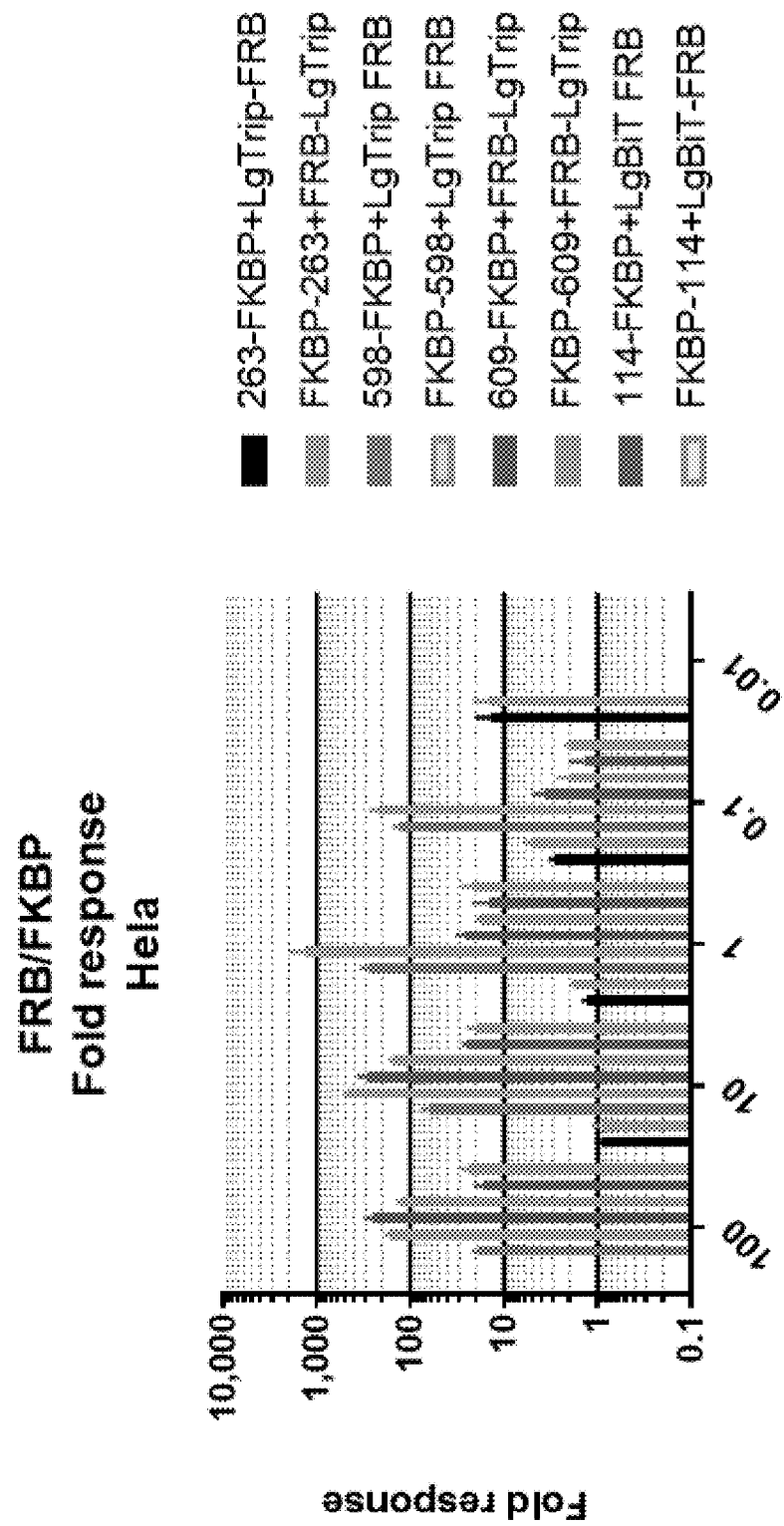
Figure 139E:
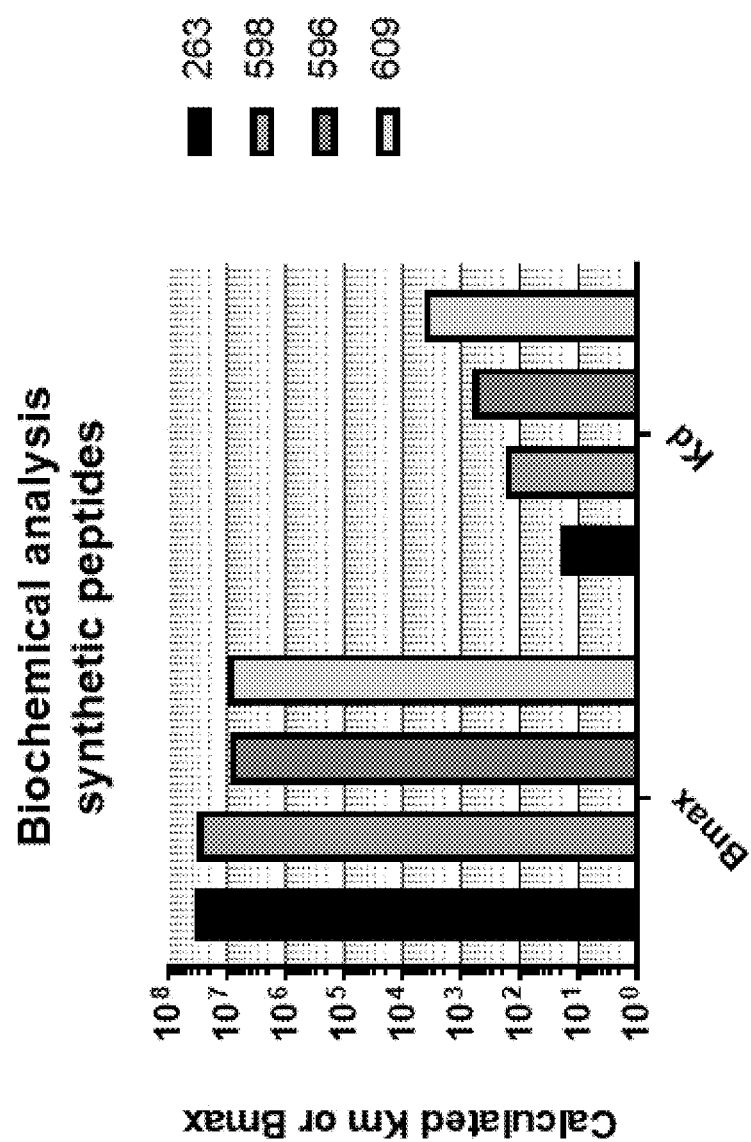

Dipeptides were diluted to 5 uM and diluted serially 5-fold using TBS+0.01% BSA +0.01% Tergitol with 0.2 nM of LgTrip as the diluent. Samples were incubated 10 minutes at room temperature and added to wells of assay plates in triplicate. One-to-one vol:vol of TBS+0.01% BSA+0.01% Tergitol with 20× diluted live cell substrate was added to samples and plates were read on a GloMax luminometer after 10 minutes. FIG. 139A-B demonstate the Kd and Bmax values from the dipeptide titrations.

Fold Response of Binary NanoTrip™ in Mammalian Cells

Growth media was removed from confluent flasks of cells. (HEK293 and Hela). Cells were washed with 10 ml of DPBS and then 3 ml of TrypLE Express trypsin was added to cells.

Cells were incubated for 3 minutes at 37° C. 10 ml of growth media was added and then cells were spun at 200RCF for 5 minutes. Media was replaced and cells were resuspend in 10 ml of growth media. Cells were counted and diluted to 200,000/ml. 100 ul of cells were plated into each well of a white assay plates and grow overnight at 37° C. with $CO_2$. The next day 100 ng/ul DNA from FRB and FKBP fusions of LgTrip (3546) and various dipeptide in each orientation were combined. 263 samples started at 1:10 dilution in carrier DNA or 10 ng/ul.

DNA samples were then diluted serially into carrier DNA (10 ul to 90 µl in 100 ng/ul carrier DNA) Next 20 ul of each DNA dilution was added to 83 ul of OptiMEM. Samples were mixed and then 6.6 ul of Viafect transfection reagent was added to each sample. Samples were incubated for 20 minutes at RT and then 5 ul of transfection complex was added to 6 wells of cells for each FRB—FKBP orientation. Plates were then grown overnight at at 37° C. with $CO_2$. The next day Rapamycin (RAP) was added to 3 of the wells for each sample to a final concentration of 100 nM. Samples were placed on orbital shaker for 1 minute and then Incubated at 37c for 30 minutes. After incubation, 100 ul of NanoGlo+50 uM Fz was added to each sample (+RAP and -RAP) and then samples were placed on orbital shaker for 5 minutes. Luminescent measurements were acquired using a Glomax Discover luminometer.

Fold response was calculated by dividing RLU values from the +RAP sample by the RLU values from the —RAP samples. Results are depicted I FIG. 139C-E. Dipeptide fusions that have lower affinity to LgTrip produce a greater fold response compared to samples with higher affinity.

Example 76

Development of a Tripartite Quantitative Assay for Anti-TNFa Biologic Agents Using Tripartite Fusion Proteins Infliximab (Remicade), Adalimumab (Humira), and Etanercept (Enbrel) are TNFa inhibitors that all bind human TNFa and also all contain a human IgG1 Fc. A quantitative assay was deveeloped for all 3 TNFa inhibitors by expressing and purifying SmTrip9- or SmTrip10-protein G and TNFa fusion proteins which serve as the binding components to the TNFa inhibitor (FIG. 140). The Protein G fusion protein will bind to the conserved IgG1 Fc region of the TNFa inhibitor. The Inhibitor will bind to the TNFa fusion protein bringing the SmTrip9 and SmTrip10 into close proximity. In the presence of LgTrip, the bioluminescent complex will form creating the signal that is proportional to the amount of TNFa inhibitor present. All reporter tag configurations were tested with SmTrip9 or SmTrip10 expressed on the N- or C-terminal of Protein G and TNFa with either a 4gly-ser or 15gly-ser linker. The optimal pairing resulting from screening all orientations was SmTrip9-15gly/ser-protein G with TNFa-15gly/ser-SmTrip10.

Methods for Making the Fusion Proteins

A fusion protein comprising of SmTrip9 pep521 (SEQ ID NO: 268) sequence followed by a linker of 15 glycine-serine repeat was fused to the N-terminus of Protein G was expressed and purified. A second fusion protein comprising of SmTrip10 pep289 (SEQ ID NO: 150) sequence was fused to the C terminus of human TNFa separated by a linker of 15 glycine-serine repeat was also expressed and purified. Streak plates from glycerol stocks of KRX transformed *E. coli* cells were created on LB plates with Ampicillin (100 ug/ml) and allowed to incubate overnight at 37° C. A single colony was inoculated into 3mls of SOC media+AMP and incubated shaking (275 rpm) overnight at 37° C. The cells were lysed and the plasmid DNA was collected. Shuffle competent *E. coli* cells were transformed with 100 ng of plasmid DNA, spread onto pre-warmed selection plates, and allowed to incubate overnight at 30° C. A colony was selected and inoculated into a 50 ml volume of LB containing ampicillin. The cultures were incubated overnight at 37° C. shaking before being diluted 1:100 into 500 mL of LB medium containing ampicillin. These flasks were allowed to incubate at 37° C. while shaking until the OD600 reached 0.6-0.8. Cells were induced by addition of IPTG at a final concentration of 1 mM and allowed to incubate overnight at 25° C. while shaking. Cells were harvested, centrifuged, and resuspended in 50 mL extraction and lysis buffer at 4° C. with mixing. Three cycles of freeze/thaw were performed followed by addition of RQI DNase. The total lysate was transferred to a think 50 mL centrifuge tube and spun at 10,000×g for 30 minutes at 4° C. 20 mM Imidazole/350 mM NaCl was added prior to loading onto a nickel column. Fusion proteins were washed and eluted off the columns in a 5 step elution process with increasing imidazole. Samples were dialyzed against TBS and final stock proteins were stored in 50% glycerol in TBS at −20° C.

Example 77

Homogeneous Quantitative Analysis of TNFa Inhibitors Infliximab, Adalimumab, and Etanercept Using SmTrip9 Pep521-Protein G and TNFa-SmTrip10 Pep289 Fusion Proteins Experiments were conducted during development of embodiments herein to determine the ability of NanoTrip™ fusion proteins to quantitate TNFa inhibitors in a homogeneous assay. The results show that protein G and TNFa NanoTrip™ fusion proteins together with LgTrip display great sensitivity and range for quantitating infliximab, adalimumab, and etanercept.

A 2× stock of the TNFa inhibitors was generated in assay buffer, serially diluted 1:2 to create a dose response, and 50 ul/well was added to a non-binding surface treated, 96 well solid-white plate (Costar 3600). A 2× master mix of the purified LgTrip 3546 (SEQ ID NO: 51) (final concentration 1 uM)+SmTrip9 pep521-protein G (SEQ ID NO: 268) (final 10 nM) +TNFa-SmTrip10 pep289 (SEQ ID NO: 150) (final 10 nM) was created in assay buffer, and 50 ul/well added. Plates were allowed to incubate at room temperature for 90 minutes. A 5× stock of Nano-Glo® Live Cell Substrate in assay buffer, 25 ul/well added to the plate for a final concentration of 10 uM, allowed to incubate for ~ 5 minutes, and luminescence measured using a GloMax® Discover. Assay buffer consisted of Blocker BSA (10%) (Thermo) diluted in PBS (pH 7.0) to a final of 0.01% BSA in PBS. Samples were tested in triplicate/plate, and n=3 independent experiments run. Data as demonstrated in FIG. 141 was analyzed for limit of detection (LOD), limit of quantitation (LOQ), and upper limit of quantitation (ULOQ).

Example 78

Homogenous Quantitative Analysis of Infliximab in Complex Sample Matrices Such as Human Serum and Urine Experiments were conducted during development of embodiments herein to determine the ability of NanoTrip™ fusion proteins to quantitate infliximab in the presence of the complex sample matrices of normal human IgG depleted serum, normal pooled human AB serum, and pooled normal human urine in a homogenous assay. Results indicate that the NanoTrip™ system was largely unaffected by the presence of urine nor the presence of serum proteins with the exception of endogenous IgG as expected.

A 2× stock containing 20 nM Infliximab in presence of the human sample matrix to be tested was created by diluting with assay buffer, and 50 ul/well added to a non-binding surface treated, 96 well solid-white plate (Costar 3600). A 2× master mix of the purified LgTrip 3546 (SEQ ID NO: 51) (final concentration 1 uM)+SmTrip9 pep521-protein G (SEQ ID NO: 268) (final 10 nM)+TNFa-SmTrip10 pep289 (SEQ ID NO: 150) (final 10 nM) was created in assay buffer, and 50 ul/well added. Plates were allowed to incubate at room temperature for 90 minutes. A 5× stock of Nano-Glo® Live Cell Substrate in assay buffer, 25 ul/well added to the plate for a final concentration of 10 uM, allowed to incubate for ~ 5 minutes, and luminescence measured using a GloMax® Discover. Assay buffer consisted of Blocker BSA (10%) (Thermo) diluted in PBS (pH 7.0) to a final of 0.01% BSA in PBS.

Samples were tested in triplicate. Data as demonstrated in FIG. 142 is displayed as signal/background.

Example 79

Kinetic Analysis of Signal Generation Via Facilitated Complementation of SmTrip9 Pep521-Protein G (SEQ ID NO: 268) and TNFa-SmTrip10 Pep289 (VS-HiBiT; SEQ ID NO:150) Fusion Proteins with Purified LgTrip 3546 (SEQ ID NO: 51) in the Presence of 100 pM of Infliximab in a Solution Phase, Homogenous Assay.

Experiments were conducted during development of embodiments herein to determine the binding kinetics of the Protein G/TNFa NanoTrip™ system to quantitate 100 pM of Infliximab in a solution phase, homogenous assay. Results show that signal generation is immediate and sustained indicating rapid binding kinetics of the fusion proteins to infliximab as well as LgTrip to the SmTrip9 and SmTrip10 fusion proteins.

A 2× stock of Infliximab (100 μM final) was generated in assay buffer, and 50 ul/well added to a non-binding surface treated, 96 well solid-white plate (Costar 3600). A 2× master mix of the purified LgTrip 3546 (SEQ ID NO: 51) (final concentration 1 uM)+SmTrip9 pep521-protein G (SEQ ID NO: 268) (final 10 nM)+TNFa-SmTrip10 pep289 (SEQ ID NO: 150) (final 10 nM) was created in assay buffer, and 50 ul/well added. A 5× stock of Nano-Glo® Live Cell Substrate in assay buffer, and 25 ul/well added to the plate for a final concentration of 10 uM. All reagents were added, and the plate immediately placed on a GloMax® Discover to read luminescence over time. Assay buffer consisted of Blocker BSA (10%) (Thermo) diluted in PBS (pH 7.0) to a final of 0.01% BSA in PBS. Samples were tested in triplicate.

Results are depicted in FIG. 143.

Example 80

Testing SmTrip9-Protein G Variants for their Ability to Measure Infliximab Via Facilitated Complementation with TNFa-SmTrip10 Pep289 (VS-HiBiT; SEQ ID NO:150) Fusion Proteins Purified LgTrip 3546 (SEQ ID NO: 51) in a Solution Phase, Homogenous Assay Experiments were conducted during development of embodiments herein to determine the ability of other SmTrip9 variants expressed as a fusion proteins to protein G to measure Infliximab via facilitated complementation with TNFa-SmTrip10 pep289 (VS-HiBiT; SEQ ID NO:150) fusion proteins purified LgTrip 3546 (SEQ ID NO: 51) in a solution phase, homogenous assay. Results show that all of the SmTrip9 pep(x)-Protein G variants tested were able to generate signal.

A 2× stock of Infliximab (10 nM final) was generated in assay buffer, and 50 ul/well added to a non-binding surface treated, 96 well solid-white plate (Costar 3600). A 2× master mix of the purified LgTrip 3546 (SEQ ID NO: 51) (final concentration 1 uM)+SmTrip9 pep(x)-Protein G (final 10 nM)+TNFa-SmTrip10 pep289 (SEQ ID NO: 150) (final 10 nM) was created in assay buffer, and 50 ul/well added. Plates were allowed to incubate at room temperature for 90 minutes. A 5× stock of Nano-Glo® Live Cell Substrate in assay buffer, 25 ul/well added to the plate for a final concentration of 10 uM, allowed to incubate for ~ 5 minutes, and luminescence was measured using a GloMax® Discover. Assay buffer consisted of Blocker BSA (10%) (Thermo) diluted in PBS (pH 7.0) to a final of 0.01% BSA in PBS. Samples were tested in triplicate. Results are depicted in FIG. 144.

Example 81

Homogeneous Quantitative Infliximab Testing SmTrip9 Pep (X)-Protein G Variants and TNFa-SmTrip10 Pep289 Fusion Proteins Experiments were conducted during development of embodiments herein to demonstrate the ability of different SmTrip9 pep(X)-Protein G variants to quantitate Infliximab via facilitated complementation with TNFa-SmTrip10 pep289 (VS-HiBiT; SEQ ID NO:150) fusion proteins with purified LgTrip 3546 (SEQ ID NO: 51) in a solution phase, homogeneous assay. Results show that all SmTrip9 variants were able to quantitate infliximab.

A 2× stock of Infliximab (10 nM final) was generated in assay buffer, and 50 ul/well added to a non-binding surface treated, 96 well solid-white plate (Costar 3600). A 2× master mix of the purified LgTrip 3546 (SEQ ID NO: 51) (final concentration 1 uM)+SmTrip9 pep(x)-protein G (final 10 nM)+TNFa-SmTrip10 pep289 (SEQ ID NO: 150) (final 10 nM) was created in assay buffer, and 50 ul/well added. Plates were allowed to incubate at room temperature for 90 minutes. A 5× stock of Nano-Glo® Live Cell Substrate in assay buffer, 25 ul/well added to the plate for a final concentration of 10 uM, allowed to incubate for ~ 5 minutes, and luminescence was measured using a GloMax® Discover. Assay buffer consisted of Blocker BSA (10%) (Thermo) diluted in PBS (pH 7.0) to a final of 0.01% BSA in PBS. Samples were tested in triplicate.

Example 82

Development of a Tripartite Quantitative Assay for Anti-EGFR Biologic Agents Using Tripartite Fusion Proteins in a Cell-Based Assay.

We developed a quantitative, cell-based assay for panitumumab and cetuximab representing a phase separation or surface chemistry like assay. Using purified SmTrip9-Protein G fusion proteins that will bind to the conserved human IgG Fc region of the EGFR inhibitor, the Inhibitor will bind to the SmTrip10-EGFR fusion protein that is expressed on the cell surface bringing the SmTrip9 and SmTrip10 into close proximity. In the presence of LgTrip, the bioluminescent complex will form creating the signal that is proportional to the amount of EGFR inhibitor present. All reporter tag configurations were tested with SmTrip9 or SmTrip10 expressed on the N- or C-terminal of protein G or on the N terminal of EGFR with either a 4gly-ser or 15gly-ser linker. The optimal pairing resulting from screening all orientations was SmTrip9-4gly/ser-protein G with EGFR-15gly/ser-SmTrip10.

Results are depicted in FIG. 145.

Example 83

Quantitation of Panitumumab Via Facilitated Complementation with SmTrip9 Pep521-Protein G (SEQ ID NO: 268) Fusion Protein and SmTrip10 Pep289-EGFR (VS-HiBiT; SEQ ID NO:150) Expressing Cells with Purified LgTrip 3546 (SEQ ID NO: 51) in a Cell-Based Homogeneous Assay.

Experiments were conducted during development of embodiments herein to determine the ability of NanoTrip™ fusion proteins to quantitate the EGFR inhibitor panitumumab in a cell-based homogeneous assay. The results show that SmTrip9 pep521-protein G (SEQ ID NO: 268) purified protein, SmTrip10 pep289-EGFR (SEQ ID NO:150) expressing cells, and LgTrip 3546 (SEQ ID NO: 51) display great sensitivity and range for quantitating panitumumab.

HEK293 cells were maintained in growth medium (DMEM) supplemented with 10% fetal bovine serum (FBS, Hyclone) at 37° C./5% $CO_2$ in a humidified tissue culture incubator. Transient reverse transfection were performed by first diluting the expression construct for the SmTrip10 pep289-EGFR (VS-HiBiT; SEQ ID NO:150) into Opti-MEM containing carrier DNA (PGEM-3ZF(~)) at a mass ratio of 1:10. The transfection reagent:DNA complex was prepared by adding FuGENE HD transfection reagent at a ratio of 1:3 (mg DNA per mL FuGENE HD) followed by 15 minutes incubation at room temperature. The resulting transfection:DNA complex was then mixed with a HEK293 cell suspension (2×10=cells/ml) in growth medium at a ratio of 1:20 (vol/vol), followed by incubation for 18-20 hours at 37° C./5% $CO_2$ in humidified tissue culture incubator.

HEK293 cells expressing the SmTrip10 pep289-EGFR (SEQ ID NO: 150) fusion protein were harvested using Trypsin-EDTA, washed in growth medium, and resuspended in Opti-MEM at a concentration of $4.5 \times 10^5$ cells/ml. 50 ul of cells/well (20,000 cells/well) are added to a non-binding surface, solid white 96 well plate (Costar 3600). A 4× stock of Panitumumab was generated in Opti-MEM, serially diluted in Opti-MEM to create dose response, and 25 ul/well added. A 4× master mix of the purified LgTrip 3546 (SEQ ID NO: 51) (final concentration 1 uM)+SmTrip9 pep521-protein G (SEQ ID NO: 268) (final 5 nM) was created in Opti-MEM, and 25 ul/well added. Plates were allowed to incubate for 1 hour at 37° C. A 5× stock of Nano-Glo® Live Cell Substrate in assay buffer, 25 ul/well added to the plate for a final concentration of 10 uM, and luminescence was measured on a GloMax® Discover. Samples were tested in triplicate. N=3 independent experiments.

Results are depicted in FIG. 146.

Example 84

Real-Time Binding Kinetic Analysis of Signal Generation via Facilitated Complementation of SmTrip9 pep521-Protein G (SEQ ID NO: 268) Purified Fusion Protein and SmTrip10 pep289-EGFR (VS-HiBiT; SEQ ID NO:150) Expressing HEK293 Cells Paired with Purified LgTrip 3546 (SEQ ID NO: 51) in the Presence of Increasing Doses of Cetuximab in a Cell-Based Homogeneous Assay.

Experiments were conducted during development of embodiments herein to determine the binding kinetics of the Protein G/EGFR NanoTrip™ system to quantitate Cetuximab in a cell-based homogenous assay. Results show that the luminescent signal increases with time in accordance with the formation of the luciferase complex. Signal generation is also dose dependent.

HEK293 cells were maintained in growth medium (DMEM) supplemented with 10% fetal bovine serum (FBS, Hyclone) at 37° C./5% $CO_2$ in a humidified tissue culture incubator. Transient reverse transfection were performed by first diluting the expression construct for the SmTrip10 pep289-EGFR (VS-HiBiT; SEQ ID NO:150) into Opti-MEM containing carrier DNA (PGEM-3ZF(~)) at a mass ratio of 1:10. The transfection reagent:DNA complex was prepared by adding FuGENE HD transfection reagent at a ratio of 1:3 (mg DNA per mL FuGENE HD) followed by 15 minutes incubation at room temperature. The resulting transfection:DNA complex was then mixed with a HEK293 cell suspension ($2 \times 10^5$ cells/ml) in growth medium at a ratio of 1:20 (vol/vol), followed by incubation for 18-20 hours at 37° C./5% $CO_2$ in humidified tissue culture incubator.

HEK293 cells expressing the SmTrip10 pep289-EGFR fusion protein were harvested using Trypsin-EDTA, washed in growth medium, and resuspended in Opti-MEM at a concentration of $4.5 \times 10^5$ cells/ml. 50 ul of cells/well (20,000 cells/well) were added to a non-binding surface, solid white 96 well plate (Costar 3600). A 4× stock of cetuximab was generated in Opti-MEM, and 25 ul/well added. A 4× master mix of the purified LgTrip 3546 (SEQ ID NO: 51) (final concentration 10 uM)+SmTrip9 pep521-protein G (SEQ ID NO: 268) (final 780 µM) was created in Opti-MEM, and 25 ul/well added. A 5× stock of Nano-Glo® Live Cell Substrate in assay buffer, and 25 ul/well added to the plate for a final concentration of 10 uM. All reagents were added, and the plate was immediately placed on a GloMax® Discover to read luminescence over time. Samples were tested in triplicate.

Results are depicted in FIG. 147.

Example 85

Testing SmTrip9-Protein G Variants for Their Ability to Measure Panitumumab via Facilitated Complementation with SmTrip10 pep289-EGFR (VS-HiBiT; SEQ ID NO:150) Expressing Cell Paired with Purified LgTrip 3546 (SEQ ID NO: 51) in a Cell-Based Homogenous Assay.

Experiments were conducted during development of embodiments herein to determine the ability of other SmTrip9 variants expressed as a fusion proteins to protein G to measure Panitumumab via facilitated complementation with SmTrip10 pep289-EGFR (VS-HiBiT; SEQ ID NO:150) expressing cells paired with purified LgTrip 3546 (SEQ ID NO: 51) in a cell-based homogenous assay. Results show that all of the SmTrip9 pep(x)-protein G variants tested were able to generate signal.

HEK293 cells were maintained in growth medium (DMEM) supplemented with 10% fetal bovine serum (FBS, Hyclone) at 37° C./5% $CO_2$ in a humidified tissue culture incubator. Transient reverse transfection were performed by first diluting the expression construct for the SmTrip10 pep289-EGFR (VS-HiBiT; SEQ ID NO:150) into Opti-MEM containing carrier DNA (PGEM-3ZF(~)) at a mass ratio of 1:10. The transfection reagent:DNA complex was prepared by adding FuGENE HD transfection reagent at a ratio of 1:3 (mg DNA per mL FuGENE HD) followed by 15 minutes incubation at room temperature. The resulting transfection:DNA complex was then mixed with a HEK293 cell suspension (2×10=cells/ml) in growth medium at a ratio of 1:20 (vol/vol), followed by incubation for 18-20 hours at 37° C./5% $CO_2$ in humidified tissue culture incubator.

HEK293 cells expressing the SmTrip10 pep289-EGFR (SEQ ID NO: 150) fusion protein were harvested using Trypsin-EDTA, washed in growth medium, and resuspended in Opti-MEM at a concentration of $4.5 \times 10^5$ cells/ml. 50 ul of cells/well (20,000 cells/well) were added to a non-binding surface, solid white 96 well plate (Costar 3600). A 4× stock of Panitumumab (final 1 nM) was generated in Opti-MEM, and 25 ul/well added. A 4× master mix of the purified LgTrip 3546 (SEQ ID NO: 51) (final concentration 1 uM)+SmTrip9 pep(X)-protein G (final 10 nM) was created in Opti-MEM, and 25 ul/well added. Plates were allowed to incubate for 1 hour at 37C. A 5× stock of Nano-Glo® Live Cell Substrate in assay buffer, 25 ul/well added to the plate for a final concentration of 10 uM, and luminescence was measured on a GloMax® Discover. Samples were tested in triplicate. N=3 independent experiments. Results are depicted in FIG. 148.

Example 86

Testing SmTrip9-Protein G Variants for Their Ability to Measure Panitumumab via Facilitated Complementation with SmTrip10 pep289-EGFR (VS-HiBiT; SEQ ID NO:150) Expressing Cell Paired with Purified LgTrip 3546 (SEQ ID NO: 51) in a cell-Based Homogenous Assay.

Experiments were conducted during development of embodiments herein to determine the ability of other SmTrip9 variants expressed as a fusion proteins to protein G to measure panitumumab via facilitated complementation with SmTrip10 pep289-EGFR (VS-HiBiT; SEQ ID NO:150) expressing cells paired with purified LgTrip 3546 (SEQ ID NO: 51) in a cell-based homogenous assay. Results show that all of the SmTrip9 pep(x)-protein G variants tested were able to quantitate panitumumab in a dose response analysis.

HEK293 cells were maintained in growth medium (DMEM) supplemented with 10% fetal bovine serum (FBS, Hyclone) at 37° C./5% $CO_2$ in a humidified tissue culture incubator. Transient reverse transfection were performed by first diluting the expression construct for the SmTrip10 pep289-EGFR (VS-HiBiT; SEQ ID NO:150) into Opti-MEM containing carrier DNA (PGEM-3ZF(~)) at a mass ratio of 1:10. The transfection reagent:DNA complex was prepared by adding FuGENE HD transfection reagent at a ratio of 1:3 (mg DNA per mL FuGENE HD) followed by 15 minutes incubation at room temperature. The resulting transfection:DNA complex was then mixed with a HEK293 cell suspension ($2 \times 10^5$ cells/ml) in growth medium at a ratio of 1:20 (vol/vol), followed by incubation for 18-20 hours at 37° C./5% $CO_2$ in humidified tissue culture incubator.

HEK293 cells expressing the SmTrip10 pep289-EGFR (SEQ ID NO: 150) fusion protein were harvested using Trypsin-EDTA, washed in growth medium, and resuspended in Opti-MEM at a concentration of $4.5 \times 10^5$ cells/ml. 50 ul of cells/well (20,000 cells/well) were added to a non-binding surface, solid white 96 well plate (Costar 3600). A 4× stock of Panitumumab (final 1 nM) was generated in Opti-MEM, and 25 ul/well added. A 4× master mix of the purified LgTrip 3546 (SEQ ID NO: 51) (final concentration 1 uM)+SmTrip9 pep(X)-protein G (final 10 nM) was created in Opti-MEM, and 25 ul/well added. Plates were allowed to incubate for 1 hour at 37° C. A 5× stock of Nano-Glo® Live Cell Substrate in assay buffer, 25 ul/well added to the plate for a final concentration of 10 uM, and luminescence was measured on a GloMax® Discover. Samples were tested in triplicate.

Results are depicted in FIG. 149.

Example 87

Quantitation of Human IL-Ibeta using NanoTrip™ Chemically Labeled-Paired Antibodies Experiments were conducted during development of embodiments herein to demonstrate the use of paired monocloncal antibodies that have been chemically conjugated with NanoTrip™ peptides to quantitation human IL-1beta. This model system consists of two monoclonal mouse antibodies that recognize IL-1beta at different epitopes. HaloTag®-SmTrip9 pep521 (SEQ ID NO: 268) was chemically conjugated to one of the antibodies, and HaloTag®-SmTrip10 pep289 (SEQ ID NO: 150) was chemically conjugated to the other antibody. In the presence of IL-1beta, the two antibodies bind to the IL-1beta thus bringing the two tags in close proximity. Addition of LgTrip 3546 (SEQ ID NO: 51) completes the complementation, and a luminescent signal is generated.

HaloTag®-SmTrip9 and HaloTag®-SmTrip10 fusion proteins are expressed and purified. Anti-IL-1beta mouse monoclonal antibody clone 508A 4A2 (Thermo) is labeled with the HaloTag®-SmTrip9 pep521 (SEQ ID NO: 268) and anti-IL-1beta mouse monoclonal antibody clone 508A 7G8 (Thermo) is labeled with the HaloTag®-SmTrip10 pep289 (SEQ ID NO: 150). The unlabeled antibodies are prepped by first doing a buffer exchange into 10 mM $NaHCO_3$(pH 8.5) using a Zeba column. Antibodies are then primed with a 20-fold excess of HaloTag® Succinimidyl Ester (O4) Ligand (Promega) and allowed to incubate at room temperature for 2 hours. A buffer exchange is done 2× using Zeba columns to remove free linker. The primed antibodies are incubated with a 4-fold excess of HaloTag®-SmTrip9 or HaloTag®-SmTrip10 overnight at 4C while mixing. HaloLink® Resin is used to remove any free HaloTag® fusion proteins.

A 2× stock of recombinant human IL-Ibeta was generated in assay buffer, serially diluted 1:2 to create a dose response, and 50 ul/well added to a non-binding surface treated, 96 well solid-white plate (Costar 3600). A 2× master mix of the purified LgTrip 3546 (SEQ ID NO: 51) (final concentration 1 uM)+SmTrip9 pep521 labeled 4A2 clone (SEQ ID NO: 268) (final 100 ng/ml)+SmTrip10 pep289 labeled 7G8 clone (SEQ ID NO: 150) (final 100 ng/ml) was created in assay buffer, and 50 ul/well added. A 5× stock of Nano-Glo® Live Cell Substrate in assay buffer, 25 ul/well added to the plate for a final concentration of 10 uM, and luminescence measured in real-time using a GloMax® Discover. Assay buffer consisted of Blocker BSA (10%) (Thermo) diluted in PBS (pH 7.0) to a final of 0.01% BSA in PBS. Samples were tested in triplicate. Data displayed is the signal that was read at the 20 minute time point.

Results are depicted in FIG. 150.

Example 88

Real-time Binding Kinetics for Human Troponin using NanoTrip™ Chemically-labeled Paired Antibodies Experiments were conducted during development of embodiments herein to demonstrate the use of paired monocloncal antibodies that have been chemically conjugated with NanoTrip™ peptides to quantitation human Troponin. This model system consists of two monoclonal mouse antibodies that recognize Troponin at different epitopes. HaloTag®-SmTrip9 pep521 (SEQ ID NO: 268) was chemically conjugated to one of the antibodies, and HaloTag®-SmTrip10 pep289 (SEQ ID NO: 150) was chemically conjugated to the other antibody. In the presence of Troponin, the two antibodies bind to the Troponin thus bringing the two tags in close proximity. Addition of LgTrip 3546 (SEQ ID NO: 51) completes the complementation and a luminescent signal is generated.

HaloTag®-SmTrip9 and HaloTag®-SmTrip10 fusion proteins are expressed and purified. Anti-troponin mouse monoclonal antibody 10-T79C (Fitzgerald) is labeled with the HaloTag®-SmTrip10 pep289 (SEQ ID NO: 150), and anti-troponin mouse monoclonal antibody 10-T79F (Fitzgerald) is labeled with the HaloTag®-SmTrip9 pep521 (SEQ ID NO: 268). The unlabeled antibodies are prepped by first doing a buffer exchange into 10 mM $NaHCO_3$(pH 8.5) using a Zeba column. Antibodies are then primed with a 20-fold excess of HaloTag® Succinimidyl Ester (O4) Ligand (Promega) and allowed to incubate at room temperature for 2 hours. A buffer exchange is done 2× using Zeba columns to remove free linker. The primed antibodies are incubated with a 4-fold excess of HaloTag®-SmTrip9 or HaloTag®-SmTrip10 overnight at 4° C. while mixing. HaloLink® Resin is used to remove any free HaloTag® fusion proteins.

A 2× stock of recombinant human Troponin (final 1 ug/ml) was generated in assay buffer, and 50 ul/well added to a non-binding surface treated, 96 well solid-white plate (Costar 3600). A 2× master mix of the purified LgTrip 3546 (SEQ ID NO: 51) (final concentration 1 uM)+SmTrip9 pep521 labeled 10-T79F clone (SEQ ID NO: 268) (final 1 ug/ml)+SmTrip10 pep289 labeled 10-T79C clone (SEQ ID NO: 150) (final 1 ug/ml) was created in assay buffer, and 50 ul/well added. A 5× stock of Nano-Glo® Live Cell Substrate in assay buffer, 25 ul/well was added to the plate for a final concentration of 10 uM, and luminescence was measured in real-time using a GloMax® Discover. Assay buffer consisted of Blocker BSA (10%) (Thermo) diluted in PBS (pH 7.0) to a final of 0.01% BSA in PBS. Samples were tested in triplicate.

Results are depicted in FIG. 151.

Example 89

Translocation Assay

HiBiT exhibits a very high affinity for the LgBiT polypeptide (KD=1 nM) and other similar complementary polypeptides. The strong interaction between the two fragments would drive complementation without any stimuli (FIG. 154), which would be unsuitable for a translocation assay. A study was conducted to determine the optimal affinity between two components (e.g., peptide and polypeptide) of a translocation assays. The optimal affinity was found to be in the range of 280 nM to 1300 nM. A quadruple mutations in LgBiT (E11K/I44M/N135V/L150S), referred to as LgBiT*, reduces its interaction with HiBiT by ~1000 fold (KD=1296 nM), rendering the HiBiT/LgBiT® pair well-suited for a translocation assay. Two different translocation assays were designed and tested.

A membrane translocation assay was developed to measure PKCα translocation from cytosol to the plasma membrane under PMA stimulus. PKCα was endogenously tagged with HiBiT at the C-terminus in HeLa cells. The clones of edited cells were isolated, and the best clone with the highest luminescence signal was chosen to perform the assay. LgBiT®membrane sensor was introduced to the clone using transfection method. Addition of PMA recruits PKCα-HiBiT to the plasma membrane, where HiBiT meets LgBiT® to produce light. Titration of PMA yielded 12- to 19-fold increase in response depending on the amount of LgBiT® transfected (FIG. 155).

A nuclear translocation assay was developed using measuring p65 movement from cytosol to the nucleus under TNFα stimulus. The nuclear translocation assay was set up similar to the membrane translocation assay. Specifically, p65 was endogenously tagged at the C-terminus in HeLa cells, and LgBiT®nuclear sensor was introduced to p65-HiBiT cell line via transfection method. Treatment of TNFα promotes translocation of p65-HiBiT to the nucleus, where complementation occurs between HiBiT and LgBiT® to yield luminescence signal. Titration of TNFα resulted in 4-fold increase in response (FIG. 156A). The assay allows measurement of protein translocation in real time. As shown in FIG. 156B, it takes approximately 30 minutes for p65 to migrate to the nucleus upon stimulation of TNFa, which is consistent with findings in the literature.

Example 90

Comparison Kd and Bmax values of LgBiT mutants with HiBiT

A solution of HiBiT peptide was prepared starting at 1.22 uM in OptiMEM+10% FBS. Serially diluted the peptide dilution 3-fold into OptiMEM+10% FBS. (300 ul in 700 ul). Diluted purified LgBiT or LgBiT mutant into OptiMEM+10% FBS to a concentration of 2 nM. 90 ul of the peptide solution was combined with 10 ul of the LgBiT dilution (0.2 nM LgBiT final). Samples were incubated on an orbital shaker for 30 minutes, and then 11 ul of 100 uM furimazine in OptiMEM+10% FBS added. Samples were placed on an orbital shaker for 5 minutes, and then luminescence read using a GloMax® Multi+luminometer. Bmax and $K_d$ was calculated with GraphPad Prism using one site specific binding non-linear regression (FIG. 157A-B).

Example 91

Affinity of LgBiT Mutant Lysates for HiBiT

Grew 37° C. overnight cultures of LgBiT and each LgBiT mutant. Diluted each culture 1:100 into LB+0.1% Rhamnose and 0.15% glucose. Grew for 20 hours at 25° C.

Lysates of each culture were prepared by diluting equal volumes of induced cultures with PLB lysis buffer. (PLB lysis buffer is 0.3× PLB+25 mM HEPES pH 7.5). Each lysate was then diluted 10,000× into PLB lysis buffer. A dilution series of synthetic HiBiT peptide starting at 300 nM was prepared into NanoGlo® Assay buffer+50 uM furimazine. 50 ul of each diluted lysate was combined with 50 ul of the peptide/NanoGlo® titration. Samples were incubated for 3 minutes, and then luminescence read samples on a GloMax® multi+luminometer (FIG. 158).

Example 92

Bioluminescence from Complexes of Truncated LgTrip3546 with Complementary Polypeptide 495 ul of OptiMEM+10% FBS was aliquoted into deep well plate. Peptides 846 and 847 were diluted to 20 uM in 500 ul of OptiMEM+10% FBS. Two-fold serial dilutions were prepared for each peptide. Then 200 ul of each dilution series was transferred to a new row and then ATG-3929 was added (2 nM final) to the 846 titration series and ATG-4794 was added to the 847 titration. As a control 250 nM pep 263 was added to 0.2 nM of LgTrip 3546. 50 ul of each sample was aliquoted in triplicate into a white assay plate and then plate was incubated with shaking for 10 minutes. After incubation 6 ul of 10× FZ LCS (167 ul of LCS in 833 ul of OptiMEM+10% FBS. Samples were mixed for 30 sec on orbital shaker then read immediately, and several times after to get peak luminescence for each condition. The mixtures of 846+ATG-3929 and 847+ATG-4794 peaked at a concentration of 1.25 uM peptide. Results are depicted in FIG. 159.

Example 93

B9 Titration

LgTrip was diluted to 0.2 nM in TBS+0.01% BSA+0.01% Tergitol, and pep289 was added to 25 uM. This solution was used as the diluent for 5-fold serial dilution series of SmTrip9 peptides. Samples were equilibrated 10 min at room temperature and aliquoted into assay plates in triplicate. TBS+0.01% BSA+0.01% Tergitol containing 20 uM furimazine was added to samples in 1:1 vol:vol ratio. Plates were incubated 10 min, and luminescence was read. To determine VS-HiBiT Kd, the same protocol was followed, but with saturating SmTrip9 (20× $K_d$) and titration of VS-HiBiT. Results are depicted in FIG. 160.

Example 94

Pep289 Titration

LgTrip was diluted to 0.2 nM in TBS+0.01% BSA+0.01% Tergitol, and pep289 was added to 25 uM. This solution was used as the diluent for 5-fold serial dilution series of SmTrip9 peptides. Samples were equilibrated 10 min at room temperature and aliquoted into assay plates in triplicate. TBS+0.01% BSA+0.01% Tergitol containing 20 uM furimazine was added to samples in 1:1 vol:vol ratio. Plates were incubated 10 min, and luminescence was read. To determine VS-HiBiT Kd, the same protocol was followed, but with saturating SmTrip9 (20× $K_d$) and titration of VS-HiBiT. Results are depicted in FIG. 161.

Example 95

Dipeptide Affinity Determination

Dipeptides pep263, pep788, and pep900 were diluted to 5 uM and diluted serially 5-fold using TBS+0.01% BSA+ 0.01% Tergitol with 0.2 nM of LgTrip as the diluent. Samples were incubated 10 minutes at room temperature and added to assay plates in triplicate. One-to-one vol:vol of TBS+0.01% BSA+0.01% Tergitol with 20× diluted live cell furimazine substrate was added to samples, and plates were read on a GloMax® luminometer after 10 minutes. Results are depicted in FIG. 162.

Example 96

Bmax Determination with LgTrip Variants and Pep788

LgTrip variants were grown overnight at 37° C. in LB with 100 μg/ml ampicillin. Cells were diluted 20-fold into induction media (LB with 100 μg/ml ampicillin and 0.1% rhamnose w/v) and induced 4 hours at 37° C. with shaking. Ten microliters of each induction sample was diluted into 250 ul lysis buffer (0.3× PLB+25 mM HEPES pH 7.5). Eighty microliters of lysates were diluted further in 2 ml lysis buffer. A 10-fold dilution series of pep788 (SEQ ID 414) was performed stating at 10 μM peptide using Nano-Glo with 50 uM furimazine as the diluent. Peptide dilutions and lysates were mixed 1:1 vol:vol, incubated 10 min at room temperature, and luminescence was read. Results are depicted in FIG. 163.

Example 97

Bmax Determination with LgTrip Variants and Pep759

LgTrip variants were grown overnight at 37° C. in LB with 100 μg/ml ampicillin. Cells were diluted 20-fold into induction media (LB with 100 μg/ml ampicillin and 0.1% rhamnose w/v) and induced 4 hours at 37° C. with shaking. Ten microliters of each induction sample was diluted into 250 ul lysis buffer (0.3× PLB+25 mM HEPES pH 7.5). Eighty microliters of lysates were diluted further in 2 ml lysis buffer. A 5-fold dilution series of pep759 (SEQ ID 496) was performed stating at 50 μM peptide using Nano-Glo with 50 uM furimazine and 50 μM pep289 (SEQ ID 826) as the diluent. Peptide dilutions and lysates were mixed 1:1 vol:vol, incubated 10 min at room temperature, and luminescence was read. Results are depicted in FIG. 164.

Example 98

Thermal Stability of LgTrip Variants

LgTrip variants were grown overnight at 37° C. in LB with 100 μg/ml ampicillin. Cells were diluted 20-fold into induction media (LB with 100 μg/ml ampicillin and 0.1% rhamnose w/v) and induced 20 hours at 25° C. with shaking. Twenty microliters of each induction was diluted into 40 ul lysis buffer (0.3× PLB+25 mM HEPES pH 7.5) and lysed for 15 min at room temperature. Lysates were diluted 1,000-fold into 1× TBS+0.01% BSA. Fifty microliters of each sample was transferred into a PCR plate and incubated at 80° C. for 1.5 hrs in a thermocycler. Controls were incubated on ice. Samples were equilibrated to room temperature and diluted 1:100 into 1× TBS+0.01% BSA. Twenty-five microliters of each sample were transferred into assay plates and mixed with 25 ul of 400 nM pep788 (SEQ ID 414) in TBS+0.01% BSA+20× diluted live cell furimazine substrate. Samples were incubated 10 minutes at room temperature, and luminescence was read. Results are depicted in FIG. 165.

Example 99

Kd and Bmax Determinations of LgTrip Variants with Pep788

LgTrip variants were purified using the Promega MagneHis™ Protein Purification System according to the manufacturer's protocol and diluted to 0.2 nM in TBS+0.01% BSA +0.01% Tergitol+25 uM pep788. This solution was used as the diluent for 5-fold serial dilution series of SmTrip9 peptides. Samples were equilibrated 10 min at room temperature and aliquoted into assay plates in triplicate. TBS+0.01% BSA+0.01% Tergitol containing 20 uM furimazine was added to samples in 1:1 vol:vol ratio. Plates were incubated 10 min, and luminescence was read. To determine VS-HiBiT Kd, the same protocol was followed, but with saturating SmTrip9 (25 uM) and titration of VS-HiBiT. Results are depicted in FIG. 166.

Example 100

Kd and Bmax Determinations of LgTrip Variants with Pep840 LgTrips variants were purified using the Promega MagneHis™ Protein Purification System according to the manufacturer's protocol and diluted to 0.2 nM in TBS+ 0.01% BSA +0.01% Tergitol+25 uM pep840. This solution was used as the diluent for 5-fold serial dilution series of SmTrip9 peptides. Samples were equilibrated 10 min at room temperature and aliquoted into assay plates in triplicate. TBS+0.01% BSA+0.01% Tergitol containing 20 uM furimazine was added to samples in 1:1 vol:vol ratio. Plates were incubated 10 min and luminescence was read. To determine VS-HiBiT Kd, the same protocol was followed, but with saturating SmTrip9 (25 uM) and titration of VS-HiBiT. Results are depicted in FIG. 167.

Example 101

Kd and Bmax Determinations of LgTrip Variants with Pep289 and Saturating Pep840

LgTrip variants were purified using the Promega MagneHis™ Protein Purification System according to the manufacturer's protocol and diluted to 0.2 nM in TBS+0.01% BSA+0.01% Tergitol+25 uM pep289+12.5 uM Pep840. This solution was used as the diluent for 5-fold serial dilution series of SmTrip9 peptides. Samples were equilibrated 10 min at room temperature and aliquoted into assay plates in triplicate. TBS+0.01% BSA+0.01% Tergitol containing 20 uM furimazine was added to samples in 1:1 vol:vol ratio. Plates were incubated 10 min and luminescence was read. To determine VS-HiBiT Kd, the same protocol was followed, but with saturating SmTrip9 (25 uM) and titration of VS-HiBiT. Results are depicted in FIG. 168.

Example 102

Half-Life Determination of LgTrip Variants

MagneHis purified LgTrip variants were diluted to 20 nM in TBS+0.01% BSA. In triplicate, 100 μl aliquots of each sample were loaded into 200 μl thin walled PCR tubes.

Samples were incubated at 70° C. in thermal cycler. Samples were removed at various time-points and equilibrated to room temperature. Samples were diluted to 0.2 nM (5 in 495β1) in TBS+0.01% BSA. 25 μl of each diluted sample was combined with 25 μl of TBS+0.01% BSA+20× diluted live cell substrate furimazine+400 nM pep788 (SEQ ID NO: 414).

Samples were incubated for 10 minutes and then read on GMM+. Half-life was calculated by non-linear regression. Results are depicted in FIG. 169.

Example 103

Rapamycin Assay with LgTrip Variants

Cultures of FKBP_SmTrip9 variants and FRB-SmTrip10 were grown overnight in LB +100 μg/ml ampicillin at 37° C. Cells were diluted 1:20 in LB with 0.15% glucose, 0.1% rhamnose, and 100 ug/ml ampicillin. Cultures were induced ~20 hr at 25° C. with shaking. PLB assay reagent was prepared with 444 nM of a MagneHis purified LgTrip variant, 90× diluted FRB-SmTrip10 culture, +/−35 nM Rapamycin. Ninety microliters of assay reagent was added to each well of 96-well assay plates. FKBP_SmTrip9 cultures were diluted 1:10 in PLB, and 10 ul was added to assay plates. Samples were incubated 30 min at room temperature. One hundred microliters of Nano-Glo containing 50 uM furimazine was added to assay plates wells, and luminescence was read on GloMax® luminometer after 5 minutes. Results are depicted in FIGS. 170-171.

Example 104

Thermal Stability of the Lysates of LgTrip Variants

LgTrip variants were grown overnight at 37° C. in LB with 100 μg/ml ampicillin. Cells were diluted 20-fold into induction media (LB with 100 μg/ml ampicillin and 0.1% rhamnose w/v) and induced 20 hours at 25° C. with shaking. Twenty microliters of each induction was diluted into 40 ul lysis buffer (0.3× PLB+25 mM HEPES pH 7.5) and lysed for 15 min at room temperature. Lysates were diluted 1,000-fold into 1× TBS+0.01% BSA. Fifty microliters of each sample was transferred into a PCR plate and incubated at 70° C. for 1.5 hrs in a thermocycler. Controls were incubated on ice. Samples were equilibrated to room temperature and diluted 1:100 into 1× TBS+0.01% BSA. Twenty-five microliters of each sample were transferred into assay plates and mixed with 25 ul of 400 nM pep788 (SEQ ID 414) in TBS+0.01% BSA+20× diluted live cell substrate. Samples were incubated 10 minutes at room temperature, and luminescence was read. Results are depicted in FIG. 172.

Example 105

Thermal Stability of the Lysates of LgTrip Variants at Different Temperature Gradients LgTrip variants were grown overnight at 37° C. in LB with 100 μg/ml ampicillin. Cells were diluted 20-fold into induction media (LB with 100 μg/ml ampicillin and 0.1% rhamnose w/v) and induced 20 hours at 25° C. with shaking. Twenty microliters of each induction was diluted into 40 ul lysis buffer (0.3× PLB+25 mM HEPES pH 7.5) and lysed for 15 min at room temperature. Lysates were diluted 1,000-fold into 1× TBS+0.01% BSA. Fifty microliters of each sample was transferred into a PCR plate and incubated at two temperature gradients, either 75-100° C. for 10 min or 50-75° C. for 1.5 hr, in a Veritas thermocycler. Controls were incubated on ice. Samples were equilibrated to room temperature and diluted 1:100 into 1× TBS+0.01% BSA. Twenty-five microliters of each sample were transferred into assay plates and mixed with 25 ul of 400 nM pep788 (SEQ ID 414) in TBS+0.01% BSA +20× diluted live cell furimazine substrate. Samples were incubated 10 minutes at room temperature, and luminescence was read. Results are depicted in FIG. 173.

Example 106

Thermal Stability of Purified LgTrip Variants

MagneHis purified LgTrip variants were diluted to 20 nM in TBS+0.01% BSA. In triplicate, 100 μl aliquots of each sample were loaded into 200 μl thin walled PCR tubes. Samples were incubated at 70° C. in thermal cycler. Samples were removed at various time-points and equilibrated to room temperature. Samples were diluted to 0.2 nM (5 in 495β1) in TBS+0.01% BSA. 25 μl of each diluted sample was combined with 25 μl of TBS+0.01% BSA+20× diluted live cell substrate furimazine+400 nM pep788 (SEQ ID NO: 414). Samples were incubated for 10 minutes and then read on GMM+. Results are depicted in FIG. 174.

Example 107

Kd and Bmax Determinations of LgTrip Variants with Pep521 and Saturating VS-HiBiT LgTrip variants were purified using the Promega MagneHis™ Protein Purification System according to the manufacturer's protocol and diluted to 0.2 nM in TBS+0.01% BSA +0.01% Tergitol+25 uM pep521. This solution was used as the diluent for 5-fold serial dilution series of SmTrip9 peptides. Samples were equilibrated 10 min at room temperature and aliquoted into assay plates in triplicate. TBS+0.01% BSA+0.01% Tergitol containing 20 uM furimazine was added to samples in 1:1 vol:vol ratio. Plates were incubated 10 min, and luminescence was read. Results are depicted in FIG. 175.

Example 108

Kd and Bmax Determinations of LgTrip Variants with Pep840 and Saturating VS-HiBiT LgTrip variants were purified using the Promega MagneHis™ Protein Purification System according to the manufacturer's protocol and diluted to 0.2 nM in TBS+0.01% BSA +0.01% Tergitol+25 uM pep840. This solution was used as the diluent for 5-fold serial dilution series of SmTrip9 peptides. Samples were equilibrated 10 min at room temperature and aliquoted into assay plates in triplicate. TBS+0.01% BSA+0.01% Tergitol containing 20 uM furimazine was added to samples in 1:1 vol:vol ratio. Plates were incubated 10 min, and luminescence was read. Results are depicted in FIG. 176.

Example 109

Kd and Bmax Determinations of SmTrip9 Variants with LgTrip Variant ATG-3546 or ATG-5146 and Saturating Pep289

LgTrip ATG-3546 and ATG-5146 were purified using the Promega MagneHis™ Protein Purification System according to the manufacturer's protocol and diluted to 0.2 nM in TBS+0.01% BSA+0.01% Tergitol+25 uM pep289. This solution was used as the diluent for 5-fold serial dilution series of SmTrip9 peptides. Samples were equilibrated 10 min at room temperature and aliquoted into assay plates in triplicate. TBS+0.01% BSA+0.01% Tergitol containing 20 uM furimazine was added to samples in 1:1 vol:vol ratio. Plates were incubated 10 min and luminescence was read. Results are depicted in FIGS. 177 and 178.

Example 109

Kd and Bmax Determinations of Pep289 with LgTrip Variant ATG-3546 or ATG-5146 and Saturating SmTrip9

LgTrip ATG-3546 and ATG-5146 were purified using the Promega MagneHis™ Protein Purification System according to the manufacturer's protocol and diluted to 0.2 nM in TBS+0.01% BSA+0.01% Tergitol+25 uM pep289. This solution was used as the diluent for 5-fold serial dilution series of SmTrip9 peptides. Samples were equilibrated 10 min at room temperature and aliquoted into assay plates in triplicate. TBS+0.01% BSA+0.01% Tergitol containing 20 uM furimazine was added to samples in 1:1 vol:vol ratio. Plates were incubated 10 min and luminescence was read. To determine VS-HiBiT Kd, the same protocol was followed, but with saturating SmTrip9 (25 uM) and titration of VS-HiBiT. Results are depicted in FIGS. 179 and 180.

Example 110

Kd and Bmax Determinations of Lysates of LgTrip Variants with Pep840 Titration

LgTrip cultures were grown overnight in LB+100 µg/ml ampicillin at 37° C. Cells were diluted 1:20 in LB with 0.15% glucose, 0.10% rhamnose, and 100 ug/ml ampicillin and induced ~20 hr at 25° C. with shaking. Cells were diluted 1000× in PLB assay reagent (0.3× PLB+25 mM HEPES pH 7.5) and lysed for 20 min. Five-fold serial dilutions of SmTrip9 pep840 were performed in NanoGlo+ 50 uM furimazine+25 uM pep289 and mixed 1:1 vol:vol with LgTrip lysates. Samples were incubated 10 min at room temperature and read on GloMax® luminometer. Results are depicted in FIGS. 181.

Example 111

Kd and Bmax Determinations of Purified LgTrip Variants with Pep840 Titration

LgTrip variants were purified using the Promega MagneHis™ Protein Purification System according to the manufacturer's protocol and diluted to 0.2 nM in TBS+0.01% BSA +0.01% Tergitol+25 uM pep289. This solution was used as the diluent for 5-fold serial dilution series of SmTrip9 peptides. Samples were equilibrated 10 min at room temperature and aliquoted into assay plates in triplicate. TBS+0.01% BSA+0.01% Tergitol containing 20 uM furimazine was added to samples in 1:1 vol:vol ratio. Plates were incubated 10 min, and luminescence was read. Results are depicted in FIGS. 182.

Example 112

Half-Life Determination of Purified LgTrip Variants

MagneHis purified LgTrip variants were diluted to 20 nM in TBS+0.01% BSA. In triplicate, 100 µl aliquots of each sample were loaded into 200 µl thin walled PCR tubes. Samples were incubated at 70° C. in thermal cycler. Samples were removed at various time-points and equilibrated to room temperature. Samples were diluted to 0.2 nM (5 in 495 µl) in TBS+0.01% BSA. 25 µl of each diluted sample was combined with 25 µl of TBS+0.01% BSA+20× diluted live cell substrate furimazine+200 nM pep900 (SEQ ID NO: 907). Samples were incubated for 10 minutes and then read on GMM+. Half-life was calculated by non-linear regression. Results are depicted in FIGS. 183.

Example 113

Rapamycin Assay with LgTrip Variants ATG-3546 and ATG-5146

Cultures of FKBP_SmTrip9 variants and FRB-SmTrip10 were grown overnight in LB +100 µg/ml ampicillin at 37° C. Cells were diluted 1:20 in LB with 0.15% glucose, 0.1% rhamnose, and 100 ug/ml ampicillin. Cultures were induced ~20 hr at 25° C. with shaking. PLB assay reagent was prepared with 444 nM of a MagneHis purified LgTrip variant, 90× diluted FRB-SmTrip10 culture, +/−35 nM Rapamycin. Ninety microliters of assay reagent was added to each well of 96-well assay plates. FKBP_SmTrip9 cultures were diluted 1:10 in PLB, and 10 ul was added to assay plates. Samples were incubated 30 min at room temperature. One hundred microliters of Nano-Glo containing 50 uM furimazine was added to assay plates wells, and luminescence was read on GloMax® luminometer after 5 minutes. Results are depicted in FIGS. 184.

Example 114

Bmax Determinations of Lystates of LegTrip Variants with Pep788, Pep900, or Pep840

LgTrip variant cultures were grown overnight in LB+100 µg/ml ampicillin at 37° C. Cells were diluted 1:20 in LB with 0.15% glucose, 0.1% rhamnose, and 100 ug/ml ampicillin and induced ~20 hr at 25° C. with shaking. Cells were diluted 5000× in 0.3× PLB assay reagent and lysed for 20 min. Five-fold serial dilutions of dipeptides pep788, pep900, or SmTrip9 pep840 with saturating pep289 were performed in Nano-Glo+50 uM furimazine and mixed 1:1 vol:vol with LgTrip lysates. Samples were incubated 10 min at room temperature and read on GloMax® luminometer. Bmax was calculated by non-linear regression. Results are depicted in FIGS. 185.

Example 115

Thermal Stability of LgTrip Variants at Different Temperature Gradients

LgTrip variants were diluted to 20 nM in 2 ml TBS+ 0.01% BSA. 100 ul of each sample was aliquoted into duplicate rows of 96-well PCR plates (make two plates). Plates were incubated for 3 hrs at high (75-100° C.) or low (50-75° C.) temperature gradients in a Veritas thermocycler. Samples were placed at 70° C. and then aliquots moved to rt at various timepoints. Samples were mixed at each timepoint with a pipette and then diluted 1:100 into TBS+0.01% BSA. (5 ul into 495 ul). 25 ul of each sample was then aliquoted into a white assay plate. 25 ul of 200 nM pep788 or pep900 in TBS+0.01% BSA+20× diluted live cell furimaizine substrate was added. The plate was incubated for 10 minutes and then read on GMM+. Results are depicted in FIGS. 186.

Example 116

Rapamycin Assay with LgTrip Variants

Cultures of FKBP_SmTrip9 variants and FRB-SmTrip10 were grown overnight in LB +100 µg/ml ampicillin at 37° C. Cells were diluted 1:20 in LB with 0.15% glucose, 0.1% rhamnose, and 100 ug/ml ampicillin. Cultures were induced ~20 hr at 25° C. with shaking. PLB assay reagent was prepared with 444 nM of a MagneHis purified LgTrip variant, 90× diluted FRB-SmTrip10 culture, +/−35 nM Rapamycin. Ninety microliters of assay reagent was added to each well of 96-well assay plates. FKBP_SmTrip9 cultures were diluted 1:10 in PLB, and 10 ul was added to assay plates. Samples were incubated 30 min at room temperature. One hundred microliters of Nano-Glo containing 50 uM furimazine was added to assay plates wells, and luminescence was read on GloMax® luminometer after 5 minutes. Results are depicted in FIGS. 187.

Example 117

Kd and Bmax Determinations of Pep691 and Pep692

LgTrip 3546 was diluted to 1 nM in OptiMEM+10% FBS. 12 µM solutions of strand 9 peptides 521 and 693 were prepared in OptiMem+10% FBS. Each strand 9 dilution was used to prepare 3-fold dilution series of each strand 10 peptide starting at 20 µM. (pep86=HiBiT, pep289=VS HiBiT, pep691=HiBiT RR, pep692=VSHiBiT RR). 90 µl of each dilution series was transferred to a white assay plate and then 10p of the 1p M stock of LgTrip 3546 added. The plate was placed on an orbital shaker set to 600RPM for 30 minutes. Detection reagent of OptiMEM+10% FBS consisting of 10 mM DTT and 50 uM Furimazine was prepared, and 11 µl added to the samples. The plate was placed on orbital shaker and mixed for 5 minutes at room temperature. The plate was read on a GloMax® Multi+luminometer. Kd and Bmax were calculated using GraphPad Prism one site specific binding. Results are depicted in FIGS. 188.

Example 118

Purification of Monomeric LgBiT-SmBiT Clones 50 ml cultures of an isolated colony of each monomeric LgBiT-SmBiT clone were grown in LB+30 ug/ml Kanamycin for 20 hours at 37°. Cultures were then diluted 1:100 (500 ul in 50 ml) in LB supplemented with 30 ug/ml Kanamycin, 0.1% Rhamnose, and 0.15% Glucose and grown at 25° C. for 20 hours. Cultures were spun and re-suspended in 9 ml of 100mMHepes pH 7.5+1 ml Fast-Break™ Cell Lysis Reagent (Promega; V8571)+200 ul RQ DNase 1 (Promega). Samples were incubated on a orbital mixer for 30 min. at 4° C. A aliquot was saved for "Total Lysate" sample. Samples were spun to clear lysate (7000RPM for 15 minutes), and supernatant was transferred to a new tube. Using the HisLink™ Spin Protein Purification System (Promega; V8550), 1 ml of HisLink™ Protein Purification Resin was added to each cleared lysated, incubated for 10 minutes at 4° C. on an orbital mixer, washed 3× with HisLink wash/binding buffer, and eluted with 500 ul elution buffer two times to recover samples.

FIG. 189 demonstrates the amount of soluble and purified protein from each monomeric LgBiT-SmBiT clone, and Table 12 lists the constructs used.

TABLE 12

| Constructs | | |
|---|---|---|
| ATG-462 | NanoLuc ® | G |
| ATG-3561 | Monomeric LgBiT-SmBiT | S |
| ATG-3562 | Monomeric LgBiT-SmBiT | G |
| ATG-3563 | Monomeric LgBiT-HiBiT | S |
| ATG-3564 | Monomeric LgBiT-HiBiT | G |

Example 119

Luminescence Determination of Monomeric LgBiT-SmBiT Clones

Purified monomeric LgBiT-SmBiT proteins from Example 118 were diluted to 0.2 nM in TBS+0.01% BSA. Diluted protein was then combined with 50 ul of Furimazine (Promega; N113) in NanoGlo® buffer (Promega; N112). Luminescence was read on a GMM+3 minutes after substrate addition.

FIG. 190 demonstrates that NanoLuc® (ATG-462) is 2× brighter than the monomeric LgBiT-SmBiT proteins.

Example 120

Substrate Utilization by Monomeric LgBiT-SmBiT Clones

Purified monomeric LgBiT-SmBiT proteins from Example 118 were diluted to 0.2 nM in TBS+0.01% BSA. A 2-fold dilution series, starting at 50 uM (40 ul in 2 ml) then 1 ml to 1 ml, of Furimazine (Promega; N113) in NanoGlo® buffer (Promega; N112) was prepared. 50 ul of each purified monomeric LgBiT-SmBiT was combined, in duplicate, with 50 ul of the titrated substrate series. Samples were incubated for 3 minutes at RT, and luminescence read on a GMM.

FIG. 191 demonstrates that each monomeric LgBiT-SmBiT protein utilizes Furimazine similarly.

Example 121

Temperature Gradient

Experiments were conducted during development of embodiments herein to determine the impact of temperature on monomeric LgBiT-SmBiT variants.

Purified monomeric LgBiT-SmBiT proteins from Example 118 were diluted to 2 nM in TBS+0.01% BSA. Each diluted sample was then aliquoted into multiple wells of a 96-well PCR plate. The plate was placed in a thermocycler set for 30 minutes with a temperature gradient:

Temperature gradient A: 54, 57, 60, 63, 66, 70° C.,
Temperature gradient B: 55, 60, 65, 70, 75, 80° C., or
Temperature gradient C: 65, 70, 75, 80, 85, 90° C.

After the 30 minute incubation, 5 ul of each sample was combined with 45 ul of TBS+0.01% BSA, 50 ul of Furimazine in NanoGlo® buffer added, incubated for 3 minutes at RT, and luminescence detected on a GMM+.

Figure 192:
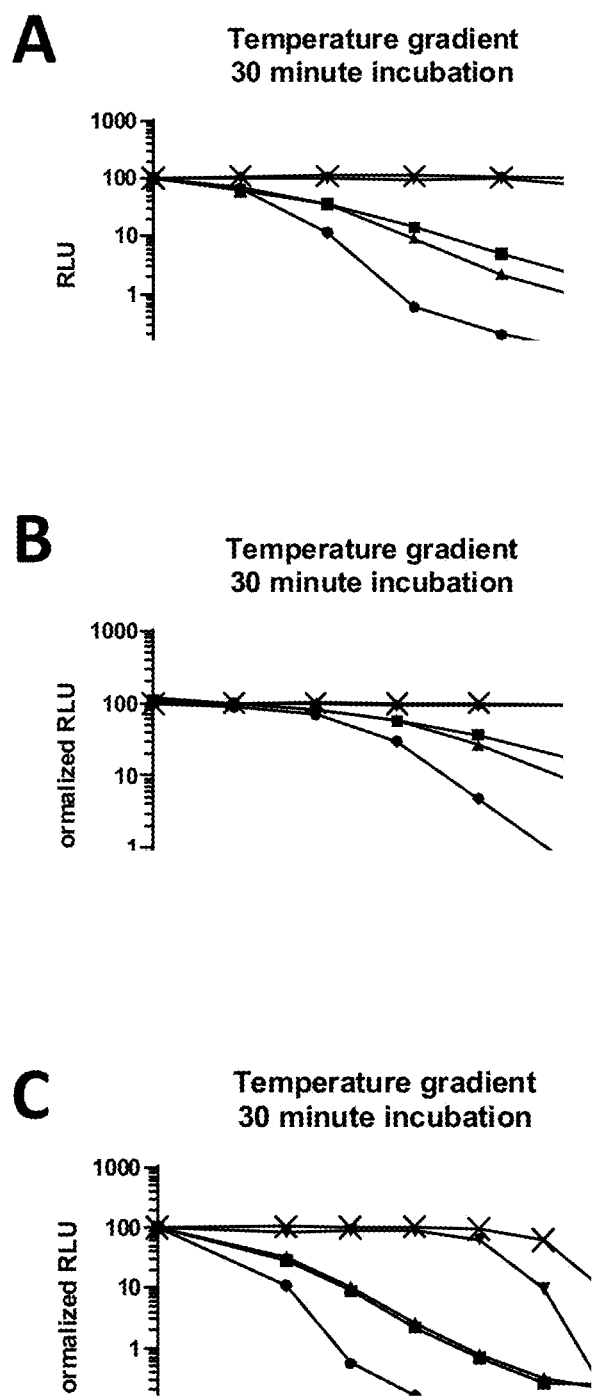

FIG. 192 demonstrates that the monomeric LgBiT-SmBiT protein are significantly more stable compared to NanoLuc® (ATG-462).

Example 122

Temperature Challenge

Experiments were conducted during development of embodiments herein to determine the impact of high temperature on monomeric LgBiT-SmBiT variants.

Purified monomeric LgBiT-SmBiT proteins from Example 118 were diluted to 2 nM in TBS+0.01% BSA. Each diluted sample was then aliquoted into multiple wells of a 96-well PCR plate. The plate was placed in a thermocycler set for 30 minutes with a temperature gradient of 75, 80, 85, 90, 95, 100° C.

After the 30 minute incubation, 5 ul of each sample was combined wth 45 ul of TBS+0.01% BSA, 50 ul of Furimazine in NanoGlo® buffer added, incubated for 3 minutes at RT, and luminescence detected on a GMM+.

FIG. 193 demonstrates that the 159G amino acid change (ATG-3563) provides enhanced thermostability over the 159S amino acid change (ATG-3564) in the monomeric LgBiT-SmBiT protein are significantly more stable compared to NanoLuc® (ATG-462).

Example 123

Stability of Monomeric LgBiT-SmBiT at 60° C.

Experiments were conducted during development of embodiments herein to determine the stability of monomeric LgBiT-SmBiT variants at 60° C.

Purified monomeric LgBiT-SmBiT proteins from Example 118 were diluted to 2 nM in TBS+0.01% BSA. Each diluted sample was then aliquoted into multiple wells of a 96-well PCR plate, and the placed placed in a thermocycler set at 60° C. At various timepoints, aliquots were removed and kept on ice. After all sample timepoints had been collected, samples were equilibrated to RT.

Once equilibrated, 5 ul of each sample was combined with 45 ul of TBS+0.01% BSA, 50 ul of Furimazine in NanoGlo® buffer added, incubated for 3 minutes at RT, and luminescence detected on a GMM+.

FIG. 194 demonstrates consistent results with the temperature gradient assay. The monomeric LgBiT-SmBiT variants are more stable than NanoLuc®.

Example 124

Stability of Monomeric LgBiT-SmBiT with Reagent at Elevated Temperature

Experiments were conducted during development of embodiments herein to determine the stability of monomeric LgBiT-SmBiT variants with a reagent at elevated temperature.

Purified monomeric LgBiT-SmBiT proteins from Example 118 were diluted to 200 nM in TBS+0.01% BSA and then further diluted to 0.2 nM (4 ul in 4 ml). 50 ul of ATG-462 or ATG-3564 was mixed with either 50 ul of 50 uM Furimazine in NanoGlo™ buffer or 50 ul of 20 uM Furimazine in TBS+0.01% BSA and placed into wells of a thin-walled 96-well PCR plate. The tray was placed in a Veritas thermocycler set at a temperature gradient of 55, 60, 65, 70, 75, 80° C. At various timepoints (FIG. 195) or after 30 (FIG. 196) minutes, aliquots were removed, and luminescence detected on a GMM+.

Example 125

Kd and Vmax Determinations of NanoLuc® Variants

Purified NanoLuc® variants were diluted to 0.2 nM in TBS+0.01% BSA. A 2-fold dilution series of Furimazine in NanoLuc® buffer starting at 50 uM (40 ul in 2 ml), and then 1 ml to 1 ml dilutions. 50 ul of sample, in duplicate, was mixed with the 50 ul of the titration series. Samples were inclubated for 3 minutes at RT, and luminescence detected on a GMM+(FIG. 197).

Example 126

Temperature Challenge of NanoLuc® Variants

Experiments were conducted during development of embodiments herein to determine the impact of high temperature on NanoLuc® variants.

Purified NanoLuc® variant proteins were diluted to 2 nM in TBS+0.01% BSA. Each diluted sample was then aliquoted into multiple wells of two 96-well PCR plates. The plates were placed in a thermocycler set for 30 minutes with a temperature gradient of 60, 65, 70, 75, 80, 85° C.

After the 30 minute incubation, 5 ul of each sample was combined wth 45 ul of TBS+0.01% BSA, 50 ul of Furimazine in NanoGlo® buffer added, incubated for 3 minutes at RT, and luminescence detected on a GMM+(FIG. 198).

The temperature challenge was repeated at a higher temperature gradient 70, 75, 80, 85, 90, 95° C. with the most stable clones identified in the above temperature challenges (FIG. 199).

Example 127

Variants on ATG-5333 and ATG-5344 Screen in the Context of a Fusion for Cell-Based Translocation Assay
a) Luminescence Detection Cultures of each variant were started from a single colony picked into 200 ul LB+ampicillin media into wells of 96 well plates and grown at 37° C. for 20 hours with shaking. The following day induction cultures were prepared by diluting 10 ul of culture into 200 ul of LB+100 ug/ml ampicillin+0.1% Rhamnose and grown for 3 hours at 37° C. A lysate was prepared from the induced cultures as follows: 10 ul of cells was transferred to 190 ul of Passive Lysis Buffer (PLB)(0.3× PLB+25 mM HEPES pH 7.5) and incubated for 5 minutes. 50 ul of lysate was transferred into two assay plates and then 50 ul of PLB assay buffer+20 uM Furimazine with either 6 uM or 0.2 uM (3 uM or 0.1 uM final) of Pep289 was added. Assay plates were incubated for 5 minutes, and then luminescence was measured. A ratio was calculated by dividing RLU from the 3 uM samples by the RLU values of the 0.1 uM samples.

TABLE 13

| Variants on ATG-5333 | | | |
|---|---|---|---|
| ATG# | 3 uM | 0.1 uM | ratio |
| 5338 | 1.1 | 0.30 | 3.7 |
| 5340 | 1.3 | 0.50 | 2.6 |
| 5407 | 1.9 | 2.70 | 0.7 |
| 5408 | 0.3 | 0.06 | 5.0 |
| 5411 | 1.4 | 1.40 | 1.0 |
| 5413 | 3.6 | 2.98 | 1.2 |
| 5414 | 1.09 | 0.54 | 2.0 |
| 5416 | 1.34 | 0.28 | 4.8 |
| 5417 | 1.62 | 0.80 | 2.0 |
| 5418 | 1.61 | 0.77 | 2.1 |
| 5419 | 1.47 | 0.36 | 4.1 |
| 5420 | 0.63 | 0.10 | 6.3 |
| 5421 | 1.97 | 1.40 | 1.4 |

TABLE 14

Variants on ATG-5344

| ATG# | 3 uM | 0.1 uM | ratio |
|---|---|---|---|
| 5338 | 1.1 | 0.30 | 3.7 |
| 5340 | 1.3 | 0.50 | 2.6 |
| 5407 | 1.9 | 2.70 | 0.7 |
| 5408 | 0.3 | 0.06 | 5.0 |
| 5411 | 1.4 | 1.40 | 1.0 |
| 5413 | 3.6 | 2.98 | 1.2 |
| 5414 | 1.09 | 0.54 | 2.0 |
| 5416 | 1.34 | 0.28 | 4.8 |
| 5417 | 1.62 | 0.80 | 2.0 |
| 5418 | 1.61 | 0.77 | 2.1 |
| 5419 | 1.47 | 0.36 | 4.1 |
| 5420 | 0.63 | 0.10 | 6.3 |
| 5421 | 1.97 | 1.40 | 1.4 | b) Kd and Bmax Calculation with Pep289

2 ml of induction media (LB+100 ug/ml AMP+0.1% Rhamnose) was innoculated with 100 ul of an overnight culture of each variant. Cells were grown for 3 hours at 37° C. 250 ul of the cells were diluted in 5 ml of PLB and incubated for ~10 minutes at RT. 20 ml of 20 uM Fz in PLB (80 ul) was prepared, and three 3× titration series of Pep289 prepared in the Fz reagent (50 uM in 2 ml) (10 ul of 5 mM sample in 990 ul, then 300 ul in 700 ul, and then the 3-dilution series combined. 50 ul of cell lysate was combined with 50 ul of Pep289 titration, incubated for 5 minutes, and then luminescence read on GMM+.

TABLE 15

Calculated Bmax and Kd for LgBiT mutants

| ATG# | Sequence | Bmax | Kd |
|---|---|---|---|
| 5333 | LgBiT' | 1 | 1 |
| 5339 | K11N | 0.58 | 13.0 |
| 5340 | R152Q | 0.9 | 2.3 |
| 5341 | V135A | 0.3 | 2.3 |
| 5408 | N156D | 0.4 | 20.2 |
| 5409 | H57Q | 0.88 | 2.2 |
| 5432 | L3H | 0.2 | 44.0 |
| 5433 | T13S | 0.42 | 3.8 |
| 5434 | P93H | 0.75 | 1.0 |
| 5435 | F120L | 0.30 | 2.5 |
| 5437 | S157R | 1.0 | 0.6 |
| 5438 | H86L | 0.82 | 1.1 |
| 5439 | M149V | 0.07 | 51.3 |
| 5456 | K11L | 0.3 | 0.6 |
| 5457 | K11R | 0.67 | 1.0 |
| 5458 | K11Y | 0.4 | 1.2 |
| 5459 | K11N + R152Q | 0.4 | 16.9 |
| 5460 | K11N + N156D | 0.3 | 25.9 |
| 5491 | K11Q | 0.9 | 0.6 |
| 5492 | K11M | 0.3 | 0.6 |
| 5493 | K11H | 0.7 | 2.8 |
| 5494 | K11F | 0.3 | 2.2 |
| 5495 | K11W | 0.2 | 2.7 |
| 5505 | V135A + R152Q | 2.0 | 1.2 |
| 5506 | V135A + R152Q + N156D | 1.5 | 4.1 |
| 5507 | P93H + V135A | 1.9 | 0.5 |
| 5508 | P93H + R152Q | 0.8 | 3.0 |
| 5509 | P93H + R152Q + N156D | 0.7 | 6.8 |
| 5510 | P93H + N135A + R152Q | 1.7 | 1.5 |
| 5511 | P93H + N135G + R152Q | 0.9 | 3.9 |

Example 128

Site Saturation of ATG-5534 Template

Experiments were conducted during development of embodiments herein to optimize the identity of the amino acid at various positions of ATG-5534 (SEQ ID NO: 978).

a) E. coli cultures were started from a single colony picked into 200 ul LB+ampicillin media into wells of 96-well plates and grown at 37° C. for 20 hours with shaking. The following day, induction cultures were prepared by diluting 10 ul of culture into 200 ul of LB+100 ug/ml ampicillin+ 0.1% Rhamnose and grown for 3 hours at 37° C. A lysate was prepared from the induced cultures as follows: 10 ul of cells was transferred to 190 ul of PLB lysis buffer (0.3× PLB+25 mM HEPES pH 7.5) and incubated for 5 minutes. 50 ul of lysate was transferred into two assay plates and then 50 ul of PLB assay buffer+20 uM Furimazine with either 6 uM or 0.2 uM (3 uM or 0.1 uM final) of pep289 was added. Assay plates were incubated for 5 minutes, and then luminescence was measured. Bmax and Kd values were determined for each mutant.

TABLE 16

Calculated Bmax and Kd for site saturation at position 44 of LgBiT mutant ATG-5810

| ATG# | Mutant | Bmax | Kd |
|---|---|---|---|
| 5654 | M44V | 1.8 | 0.4 |
| 5655 | M44I | 4.3 | 0.13 |
| 5676 | M44K | 0.03 | 19.4 |
| 5677 | M44E | 0.02 | 15.7 |
| 5678 | M44A | 0.4 | 2.1 |
| 5679 | M44C | 0.4 | 1.1 |
| 5680 | M44W | 0.4 | 0.1 |
| 5681 | M44G | 0.1 | 11.9 |
| 5682 | M44H | 0.4 | 2.5 |
| 5683 | M44S | 0.2 | 2.9 |
| 5684 | M44Q | 0.4 | 0.8 |
| 5685 | M44R | 0.001 | 0.0 |
| 5686 | M44T | 0.4 | 1.3 |
| 5687 | M44Y | 0.2 | 1.1 |
| 5688 | M44L | 0.9 | 0.8 |
| 5689 | M44P | 0.0 | 3.4 |
| 5690 | M44F | 0.8 | 1.0 | b) Comparison in E. coli and Mammalian Cells i) E. Coli (Kd and Bmax)

2 ml of induction media (LB+100 ug/ml AMP+0.1% Rhamnose) was inoculated with 100 ul of an overnight culture for each mutant. Cells were grown for 3 hours at 37° C. in a tube. 250 ul of cells were diluted in 5 ml of PLB lysis buffer and incubated for ~10 minutes at RT. 20 ml of 20 uM Furimazine in PLB lysis buffer (80 ul) was prepared, and three 3× titration series of pep289 in the Furimazine reagent (50 uM in 2 ml) (10 ul of 5 mM sample in 990 ul, then 300 ul in 700 ul with the 3-dilution series combined). 50 ul of cell lysate was mixed with 50 ul of pep289 titration, incubated for 5 minutes at RT, and then luminescence read on GMM+.

ii) Mammalian Cell Expression a) Transfection protocol: Media from HeLa cells (PKCα-HiBiT clone) that were grown to confluency in a T-150 flask was aspriated, and cells washed with 10 ml DPBS. (Life Technologies 14190). The DPBS was aspirated, and 4 ml of TryPLE Express Trypsin (Life Technologies 12604) added. Cells were incubated for 2-3 minutes at 37° C., then resuspend in 16 ml of growth media (DMEM Life Technologies 11995)+10% FBS (VWR 89510-194). Cells were spun at 200RPM for 5 minutes, supernatant aspirated, and 20 ml of DMEM+10% FBS added. Cells were counted and then diluted to 1,000, 000 cells per ml. 1 mL of cells with 3 mL of DMEM+ 10% FBS were plated into 6 cm dishes and incubated for 24h.

b) Transfection complex: For each DNA sample to be tested, 10 ug of DNA (1 ug of DNA encoding membrane sensor, and 9 μg of carrier DNA) (Promega E4882) combined and mixed with 400 ul of OptiMem (Life Technologies 11058), 30 μl of FugeneHD transfection reagent (Promega E2311) added, and incubated for 10 min at ambient temperature. Transfection complex was added to the plated cells and incubated for 24 h.

c) Cell-based luminescence assay: Media was aspirated from the transfected cells HeLa cells, and then the cells were washed with 5 ml DPBS. (Life Technologies 14190). The DPBS was aspirated, and 0.75 ml of TryPLE Express Trypsin (Life Technologies 12604) added. Cells were incubated for 2-3 minutes at 37° C., and then resuspended in 4 ml of growth media (DMEM Life Technologies 11995)+10% FBS (VWR 89510-194). 100p of each sample was added to each well of a white 96 well assay plate (Corning 3917). For each sample, 30 wells in total were used, 10 wells per row with 3 rows. Cells were incubated for another 16-24h.

The following morning, growth media was aspirated and replaced with 90 μl of $CO_2$ independent media (Life Technologies 18045)+10% FBS containing 1.1x NanoGlo® Live Cell Substrate (Promega N2012), incubated for 10 min, and 10p of titrated PMA compound added to each well. (See, e.g., FIGS. 225-227). Luminescence was detected on a Glomax® Multi+luminometer set to 37° C. with a kinetic run over the course of 1 hour. Unless otherwise stated, the reported luminescence is the peak height of the kinetic run.

TABLE 17

RLU, S/B, Bmax, and Kd Values Normalized to ATG-5534

| Sample | Mutation | Membrane sensor RLU | S/B | E. Coli Bmax | Kd |
|---|---|---|---|---|---|
| ATG-5534 | WT | 1 | 4.5 | 1 | 1 |
| ATG-5652 | Y16F + Q20P + Q152H | 0.3 | 5.2 | 1.7 | 2.3 |
| ATG-5653 | M106R + Y114F | 0.6 | 3.8 | 2 | 1 |
| ATG-5654 | M44V | 4.4 | 2.4 | 1.8 | 0.4 |
| ATG-5655 | M44I | 5.2 | 2.1 | 4.3 | 0.13 |
| ATG-5656 | M106R | 1 | 3.2 | 3.5 | 0.76 |
| ATG-5657 | M106T | 0.7 | 3.6 | 2.2 | 0.77 |
| ATG-5658 | M106R | 0.8 | 4.1 | 3.2 | 0.61 |
| ATG-5659 | M106K + K136E | 0.7 | 4.4 | 3.1 | 1.58 |
| ATG-5660 | V36G | 0.8 | 3.3 | 3.7 | 1.1 |
| ATG-5661 | M106L + I138K | 0.6 | 4.2 | 3.7 | 0.68 |
| ATG-5688 | M44L | 1.72 | 3.1 | 0.89 | 0.76 |
| ATG-5690 | M44F | 0.24 | 3.5 | 0.79 | 0.98 |

Example 129

Strand 9 Detector Polypeptides

A polypeptide construct was prepared by placing a strand 10 sequence at the N-terminus of a LgTrip polypeptide. This configuration produces increased luminescence in the presence of strand 9 sequences. Experiments were conducted during development of embodiments herein to determine the limits of detection for the strand 9 peptides being tested (pep521 and pep840).

a) Strand 9 Detector Proteins with pep521 and pep840

Each strand 9 detector protein was diluted to 20 nM in TBS+0.01% BSA. A 3× dilution series of pep521 and pep840 was diluted in TBS+0.01% BSA starting at 20 uM. 50 ul of each enzyme dilution in duplicate was combined with 50 ul of each peptide titration and incubated for 10 minutes on a shaker for pre-equilibration. An assay buffer was prepared by diluting Nano-Glo Live Cell Substrate (Furimazine; Promega; N205) 30-fold into TBS+0.01% BSA, 100 ul added to each well, incubated for 5 minutes at RT, and luminescence then read on GMM+. The background reading was obtained from samples that contained no peptide.

FIG. 200 shows that all three strand 9 detector proteins bound more tightly to pep840 than to pep521.

b) Strand 9 Detector Proteins with pep840

Each strand 9 detector protein was diluted to 200 nM in TBS+0.01% BSA. A 3× dilution series of pep840 was diluted in TBS+0.01% BSA starting at 0.5 uM. 50 ul of each enzyme dilution in quadruplicate was combined with 50 ul of each peptide titration and incubated for 10 minutes on a shaker for pre-equilibration. An assay buffer was prepared by diluting Nano-Glo Live Cell Substrate (Furimazine; Promega; N205) 30-fold into TBS+0.01% BSA, 100 ul added to each well, incubated for 5 minutes at RT, and luminescence then read on GMM+. The background reading was obtained from samples that contained no peptide.

Regarding FIG. 20, the panel on the left shows a titration of Strand 9 peptide 840 in the presence of 50 nM of three strand 9 detector constructs. The panel on the right shows the background (no peptide 840) for each strand 9 detector and the signal to background ratio at 0.1 nM peptide 840 for each strand 9 detector.

Example 130

Linker Test Series a) Overnight cultures of circularly-permuted, strand 9 detector variants were diluted to 1:20 (150 ul to 3 ml) in LB+0.1% rhamnose+100 ug/ml ampicilin, grown for 4 hours at 37° C., and then lysed in PLB lysis buffer (0.3× PLB+25 mM HEPES pH 7.5) (500 ul of lysate to 4.5 ml of PLB lysis buffer). To assay, lysates were diluted 1:100 into TBS+0.01% BSA. A 3× dilution series of pep840 (strand 9) was prepared starting at 10 nM. 50 ul of each dilute lysate was combined with 50 ul of peptide titration and incubated for 20 minutes at RT on a shaker set at 600 rpm. 100 ul Nano-Glo® buffer+50 uM Furimazine was added to each well, and luminescence then read on GMM+. The linkers used for each construct tested were: ATG-4992, 8GS; ATG-5485, 5GS; ATG-5486, 6GS; ATG-5487, 7GS; ATG-5488, 9GS; ATG-5489, 10 GS; and ATG-5490, 11 GS.

FIG. 202 shows that each clone, other than ATG-5485, which has a 5AA linker, produced similar luminescence to ATG-4992. The experiments demonstrate that linker length between strand 10, and LgTrip did not play a significant role in the detection of strand 9 sequences.

b) 8GS Linker (ATG-4992) vs. 11 GS (ATG-5490) Linker

ATG-4992 and ATG-5490 proteins were purified using the MagneHis purification system. (Promega). Purified protein for 4992 and 5490 were diluted to 100 nM in $CO_2$ independent media+10% FBS. A 3-fold serial dilution of pep840 was prepared starting at 10 nM in Nano-Glo® buffer+50 uM furimazine(Promega N113). 50 ul of each enzyme dilution was combined in quadruplicate with 50 ul the peptide titration. Luminescence was measured over time on a GMM+luminometer.

FIG. 203 show the data plotted is from the 50-minute kinetic read and that 5490, which has the longer linker, provided 2-fold more luminescence over 4992.

Example 131

Determination of Kd of ATG-4992 and ATG-5490 variants

Figure 204:
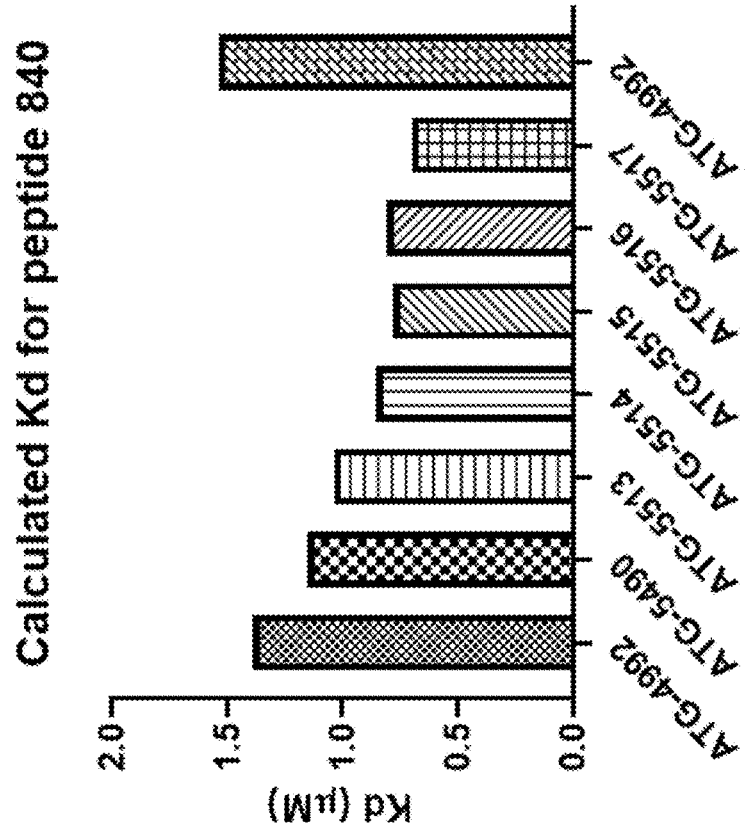

Overnight cultures of each variant were prepared in LB+100 ug/ml ampicillin. The following day, cultures were diluted 1:20 (150 ul to 3 ml) in LB+0.1% Rhamnose+100 ug/ml ampicillin. Cultures were grown for 4 hours at 37° C. and then lysed with PLB lysis buffer (0.3× PLB (Promega)+ 25 mM HEPES pH 7.5)(500 ul of lysate to 4.5 ml of PLB lysis buffer). To assay, lysates were diluted 1:100 into TBS+0.01% BSA. A 3× dilution series of strand 9 (pep840) was prepared starting at 40 uM. 50 ul of the titration series was combined with 50 ul of the each diluted lysate, incubated for 20 minutes at RT on orbital shaker set to 600 rpm, 100 ul of Nano-Glo® buffer+50 uM Furimazine (Promega; N113) added, and luminescence read on GMM+. Results are depicted in FIG. 204.

Example 132

Comparison of ATG-4992 and ATG-5490 variants

ATG-4992 and ATG-5490 variant proteins were purified using the MagneHis purification system. (Promega). Purified proteins were then diluted to 100 nM in $CO_2$ independent media+10% FBS. A 3-fold serial dilution of pep840 was prepared starting at 2 nM in Nano-Glo® buffer+50 uM furimazine(Promega N113). 50 ul of each enzyme dilution was combined in triplicate with 50 ul the peptide titration. Luminescence was measured every 5 minutes on a GMM+ luminometer. Results are depicted in FIG. 205 as data plotted from the 60-minute timepoint and show that variants 5515 and 5517 have lower calculated Kd values (Example 131) and show higher RLU signal to background values when paired with pep840.

Example 133

Screen of ATG-4166 Variants

TABLE 18

LgBiT sequences in different backbones. (C-terminal His Tag for protein purification or sensor fusion (pH domain-GSSG-HaloTag®-GSSG-LgBiT mutant).

| pF1A (His tag for purificatoin | Equivalent sequence (sensor backbone) | Sequence compared to LgBiT |
|---|---|---|
| ATG-2623 | LgBiT | LgBiT |
| ATG-4166 | ATG-5333 | LgBiT + E11K + I44M + N135V + L150S |
| ATG-5810 | ATG-5534 | LgBiT + E11K + I44M + L150S + V135A + R152Q |
| ATG-5819 | ATG-5655 | LgBiT + E11K + L150S + P93H + N135A + R152Q |
| ATG-5820 | ATG-5654 | LgBiT + E11K + I44V + L150S + P93H + N135A + R152Q |
| ATG-5821 | ATG-5690 | LgBiT + E11K + I44F + L150S + P93H + N135A + R152Q |
| ATG-5822 | ATG-5688 | LgBiT + E11K + I44F + L150S + P93H + N135A + R152Q | i) Bmax and Kd Determination

ATG-4166 variant proteins were purified using the MagneHis purification system. (Promega). Purified proteins were then diluted to 0.2 nM in TBS+0.01% BSA. A 3-fold serial dilution of pep289 (VS-HiBiT) was prepared in TBS+0.01% Tergitol with one series starting at 400 nM and the other at 20 uM. 50 ul of each enzyme dilution (0.2 nM) was combined with 50 ul the peptide titration and incubated on a shaker for 10 minutes. 100 ul of Furimazine (N113) diluted 250-fold in TBS+0.0.1% Tergitol was added, and samples again placed on a shaker for 5 minutes. Luminescence was measured on a GMM+luminometer. Bmax and Kd were calculated, and results depicted in FIG. 206.

ii) Activity at Various pH

ATG-4166 variant proteins were diluted to 0.2 nM in TBS+0.01% BSA. 20 uM pep289 (VS-HiBiT) to each variant protein sample and incubate at RT for 20 minutes. 990 ul of each pH buffer solution was added to a well a deep well plate. 10 ul of Furimazine (N113) was added to each well, and 50 ul of each variant protein/peptide sample added to each well. The plate was incubated at RT for 12 minutes, and luminescence was measured on a GMM+luminometer. Activity was calculated, and results depicted in FIG. 207.

pH Buffer Series Preparation: Components listed in the table below were mixed in 400 ml of water. 30 ml of the buffer was added to twelve 50 ml tubes, and either NaOH or HCl used to create the necessary pH.

TABLE 19

Formulation for universal pH buffer

| Component | Stock | Amount | Unit | Concentration (400 ml) |
|---|---|---|---|---|
| Na Citrate | Powder | 5.88 | g | 50 mM |
| MES Hydrate | Powder | 3.9 | g | 50 mM |
| PIPES | Powder | 6.05 | g | 50 mM |
| HEPES | 1M | 20 | ml | 50 mM |
| TAPS | Powder | 4.87 | g | 50 mM |
| Tergitol | 100% | 1 | ml | 0.25 |
| Mazu | 100% | 0.1 | ml | 0.025 |
| ATT | powder | 57 | mg | 1 mM |

Example 134

Screen of ATG-5823, ATG-5824, and ATG-5825 Variants

Variant proteins (ATG-5823, ATG-5824, and ATG-5825) were purified using Magne His purification system (Promega). ATG-5146 was purified using an AKTA with Nickel Sepharose column. Purified proteins were diluted first to 200 nM in TBS+0.01% BSA and then further diluted to 0.2 nM in TBS+0.01% BSA. A three-fold dilution series of pep263 was prepared starting at 100 nM in TBS+0.01% BSA+ 0.02% tergitol. 50 ul of each enzyme was combined with 50 ul of the peptide dilution series. Samples were incubated on orbital shaker (600RPM) for 10 minutes. After incubation, 100 ul of LCS (N205; Promega) was diluted 1:30 into TBS+0.01% BSA and added to each sample. Samples were incubated for 3 minutes at RT, and then luminescence measured on a GloMax® Multi+. Bmax and Kd were calculated, and results depicted in FIG. 208 show similar Bmax and Kd for these variants.

Example 135

Screen of ATG-5826 and ATG-5827 Variants
i. pep86

Variant proteins (ATG-5826 and ATG-5827) were purified using MagneHis purification system (Promega V8500). Purified proteins were diluted first to 200 nM in TBS+0.01% BSA and then further diluted to 0.2 nM in TBS+0.01% BSA. Two 2-fold titration series of pep86 were prepared starting at 1 uM and 100 nM in TBS+0.01% BSA+0.02% Tergitol. 50 ul of ATG-5826 and ATG-5827 were combined with 50 ul of the peptide dilution series that started at 1 uM. 50 ul of LgBiT protein (Promega; N401C) was combined with the peptide titration series that started at 100 nM. Samples were incubated on orbital shaker (600RPM) for 10 minutes. After incubation 100 ul of LCS (N205; Promega) was diluted 1:30 into TBS+0.01% BSA and added to each sample. Samples were incubated for 3 minutes at RT, and then luminescence measured on a GloMax® Multi+. Bmax and Kd were calculated, and results depicted in FIG. 209 show similar Bmax and Kd for these variants. Clones with 760 sequence for strand 9 showed a significantly higher $K_d$. This shows that variants such as these two containing the 760 sequence have higher $K_d$ valued. ii. pep114

Variant proteins (ATG-5826 and ATG-5827) were purified using MageHis purification system (Promega V8500). Purified proteins were diluted first to 200 nM in TBS+0.01% BSA and then further diluted to 0.2 nM in TBS+0.01% BSA. Two 2-fold titration series of pep114 was prepared starting at 1 mM in TBS+0.01% BSA+0.02% tergitol. 50 ul of ATG-5826, ATG-5827, and LgBiT protein (Promega N401C) were combined with the peptide titration series. Samples were incubated on orbital shaker (600RPM) for 30 minutes. After incubation, 100 ul of LCS (N205 Promega) was diluted 1:30 into TBS+0.01% BSA and added to each sample. Samples were incubated for 3 minutes at RT, and then luminescence measured on a GloMax® Multi+. Bmax and Kd were calculated, and results depicted in FIG. 210 show similar trend for Bmax values compared to pep86 (ATG-5826>LgBiT>ATG-5827). Both ATG-5826 and ATG-5827 have slightly lower calculated Kd values compared to LgBiT/pep114, but significantly higher $K_d$ values compared to LgBiT/HiBiT(pep86).

Example 136

SDS-PAGE of ATG-5823, ATG-5824, ATG-5825, ATG-5826, and ATG-5827 Variants

Each variant protein was diluted to 0.1 ug/ml in TBS+1× SDS loading dye. Samples were heated to 70° C. for 5 minutes and then 3 ul (0.3 ug) was loaded to an SDS PAGE gel (BioRad Criterion). Results depicted in FIG. 211.

Example 137

Spike-in Antibody Titration Using 3 Labeling Methods: NanoTrip™, Sulfhydryl-Trip Labeling, and NHS-CA-HaloTag®-Trip labeling FIG. 212 provides a demonstration of each labeling method.
i) NanoTrip™-Genetic fusion A two-fold antibody titration starting at 4 ug/mL was prepared in PBS+0.01% BSA or PBS+20% human serum leaving the 24th well as the "no antibody" control. (Pool equal amounts of Sino antibodies D1-D5). 50 ul of each antibody titration was added to wells of a white assay plate in triplicate. A master mix for each combination with each strand 9 and 10 protein and 2 µM of LgTrip was prepared. 125 ng/ml was used for ATG-5547 and ATG-5546 and 500 ng/ml for ATG-5541. 50 ul of the master mix for each combination (ATG-5546+ATG-5541 or ATG5547+ATG-5541) was added to the antibody titrations and incubated for 60 minutes at RT. A detection reagent was made by diluting NanoGlo® Live Cell Substate (N205) 1:30 in PBS+0.01% BSA, and 100 ul added to each sample. Plates were incubated for three minutes, and then luminescence measured on a GloMax® Discover. RLU readings were divided by the "no antibody" control to obtain Signal/Background readings.

ii) Sulfhydryl-Trip and NHS-CA-HaloTag®-Trip Labeling

FIG. 214 demonstrates that three different NanoTrip™ detection methods are capable of detecting SARS-COV/COV2 antibody.

| Sino Biologicals (SARS-CoV/SARS-CoV2 spike)Antibodies: | | |
|---|---|---|
| D1 | 40150-D001 | HA14MA0604 |
| D2 | 40150-D002 | HA14FE2802 |
| D3 | 40150-D003 | HA14FE2803 |
| D4 | 40150-D004 | MA14AP0203 |
| D5 | 40150-D005 | HA14FE2502 |

About 50 ul 2× RBD reagents+2× LgTrip prepared in 0.01% PBSA were added to wells of a 96-well assay plated. For the NHS-CA-HaloTag®-Trip labeling, RBD reagent was prepared as a final concentration/well of 8 ng/ml RBD-HaloTag®-HiBiT+16 ng/ml RBD-HaloTag®-SmTrip9 (pep840)+1 uM LgTrip ATG-5146. For Suldhydryl-Trip labeling, RBD reagent was prepared as a final concentration/well of 15 ng/ml RBD-HiBiT+15 ng/ml SulfoSE-PEG6-RBD-SmTrip9 (pep840)-PSA (FIG. 213)+1 uM LgTrip ATG-5146. 50 ul 2× pooled antibodies prepared in either 0.01% PBSA or 20% serum diluted in 0.01% PBSA was added to each sample and incubated for 45 minutes. 20 uM NanoGlo® Live Cell Substrate was prepared in 0.01% PBSA, 100 ul added to each well, and total luminescence read on a luminometer.

Example 138

SARS-CoV-2 Nucleocapsid Titration

Anti-nucleocapsid Ab clone 9547 (Meridian Biosciences) and anti-nucleocapsid Ab clone 9548 (Meridian Biosciences) were labeled with HaloTag®-SmTrip9(pep840) and HaloTag®-VSHiBiT, respectfully. 25 ul/well of a 4× cocktail of Abs+LgTrip ATG-5146 was added to wells of a non-binding surface, solid white 96 well microtiter plate (Costar 3600) for a final concentration/well of 30 ng/ml Ab-SmTrip9+60 ng/ml Ab-HiBiT+1 uM LgTrip ATG-5146. 25 ul/well of a 4× solution of recombinant nucleocapsid protein (Meridian Biosciences Cat #9560) was added to each well followed by the addition of 50 ul/well of a 2× solution of NanoGlo® Live Cell Substrate for final concentration/well of 10 uM substrate. Plates were incubate for 15 minutes, and total luminescence measured on GlowMax luminometer.

FIG. 215 demonstrates ternary NanoLuc®-labeled antibodies detect SARS-CoV-2 Nucleocapsid protein.

Example 139

Point of Care Swabs for SARS-CoV-2 Nucleocapsid Protein in Nasopharyngeal Swab Samples A stock solution containing 120 ng/ml Anti-nucleocapsid antibody HaloTag®-SmTrip9, 240 ng/ml Anti-nucleocapsid antibody HaloTag®-HiBiT, 4 uM LgTrip ATG-5146, 40 uM Furimazine in ethanol, 1.2 mM azo-thiothymine (ATT), 1.2 mM ascorbic acid, 0.6% pullulan w/v, 4.8 mM HEPES buffer pH 8.0, 21.6 mM Glycine, 4.8 mM histidine, 6 mg/ml sucrose, and 0.0024% Polysorbate 80 was created. 100 ul of the stock solution was dispensed into plastic swab jackets and loaded onto the lyophilizer (Virtis Genesis 12EL) with shelves pre-set to 4.0° C. Upon evacuation of the system, the lyophilization process was performed between shelf temperatures of −25° C. and +25° C. The ice sublimation phase lasted 8 hr, and the bound water desorption phase lasted 16 hr. At the end of the lyophilization process, the swabs were back filled with N° and sealed by inserting a second plastic swab jacket manually.

Swabs containing the lyophilized assay reagents were then rehydrated with 100 ul of nasopharyngeal swab samples+300 ul PBS containing 0.01% BSA. Total luminescence was measured on a handheld luminometer (Prom4ega) at times 15, 30, 45, and 60 minutes and plotted.

FIG. 216 show the results from 3 PCR confirmed negative (NS46, NS47, and NS52) and 3 PCR confirmed positive samples (PS46, PS49, and PS56).

Example 140

Monomeric NanoBiT® with Fluoro-Fz

Each enzyme to be tested was diluted into TBS+0.01% BSA. A titration series with either Furimazine (N205) or JRW-1677 was made either TBS (start at 20 uM) or Nano-Glo® buffer (start at 25 uM; Promega N112). Each substrate was serially diluted with either TBS+0.01% BSA or Nano-Glo® buffer. 50 ul of each enzyme dilution was combined with 50 ul of each substrate titration. Plates were incubated for 3 minutes, and then luminescence measured on GMM+ luminometer. GraphPad Prism was used to generate a non-linear regression using Michaelis-Menten Least squares fit.

FIG. 217 provide the kinetic parameters (Vmax and Km) for Furimazine and JRW-1667. NanoLuc® (ATG-462) produced higher RLU values with both Furimazine and JRW-1667 (~10-20 fold) compared to the Monomeric NanoBiT® constructs when TBS is used to dilute substrates. NanoLuc® and the monomeric constructs showed similar RLU values in Furimazin/NanoGlo® buffer, but only NanoLuc® showed improved luminescence with JRW-1667. Although the monomeric NanoBiT® constructs showed lower RLU values with both Furimazine and JRW-1667, RLU values were similar for the two buffers and two substrates.

Km values were lower in TBS+0.01% BSA compared to NanoGlo, but generally the Km values were similar for each condition except ATG-3562 (Monomeric LgBiT-SmBiT), which shows a lower calculated Km for all conditions tested.

Example 141

Mammalian Cell Expression and Fluorescence Imaging

Transfection protocol: Preparing cells: Aspirated media from HeLa cells that were grown to confluency in a T-75 flask and washed cells with 10 ml DPBS. (Life Technologies 14190). Aspirated DPBS and added 2 ml of TryPLE Express Trypsin (Life Technologies 12604). Incubated cells for 2-3 minutes at 37° C. then resuspended cells in 8 ml of growth media (DMEM Life Technologies 11995)+10% FBS (VWR 89510-194). Spun cells at 200RPM for 5 minutes. Aspirated supernatant and added 10 ml of DMEM+10% FBS.

Counted cells and then diluted to 100,000 cells per ml. Plated 3 mL of cells to each well of 6 well plate. Incubated cells for 24 h.

Transfection complex: For each DNA sample to be tested, combined and mixed 2.5 pg of DNA (0.25 pg of DNA encoding sensor, and 2.25 pg of carrier DNA) (Promega E4882) with 100 ul of OptiMem (Life Technologies 11058). Next added 7.5Il of Fugene HD transfection reagent (Promega E2311) and incubated transfection complex for 10 min at ambient temperature. Added transfection complex to each well containing plated cells. Incubated cells for 24 h.

Fluorescence Imaging: Replated transfected cells to 8-well chamber slides (MatTek glass bottom). Aspirated media from transfected cells HeLa cells and washed cells with 3 ml DPBS. (Life Technologies 14190). Aspirated DPBS and add 0.5 ml of TryPLE Express Trypsin (Life Technologies 12604). Incubatde cells for 2-3 minutes at 37° C. then resuspended cells in 3 ml of growth media (DMEM Life Technologies 11995)+10% FBS (VWR 89510-194). Counted cells and then diluted to 50,000 cells per mL. Plated 500 µl of each well. For cellular markers that are delivered by BacMam transduction, after 3h of plating, add 10% (v/v) of CellLight Plasma Membrane-GFP (Thermo Fisher C10607) or CellLight Golgi-GFP (Thermo Fisher C10592) or CellLight Lysosome-GFP (Thermo Fisher C10507). Incubated cells for another 16-24h.

The following morning, aspirated growth media and replaced with 400 µl of FluoroBrite DMEM+10% FBS (Life Technologies A1896701)+10% FBS. Prepared 5× dilution of Janelia Fluor 549 HaloTag® (Promega GA1110) in Fluoro-Brite DMEM+10% FBS, and add 100 µl to each well. Incubated for 30 min. Washed cells with 500 µl FluoroBrite DMEM+10% FBS for 30 min. Cells were stained with appropriate cellular markers. Staining procedure was followed by manufacture recommendation. Stained mitochondria with MitoTracker Green FM (Thermo Fisher M7514). Stain endoplasmic reticulum with ER-Tracker Red (Thermo Fisher E34250). Counterstain cells with the nuclear probe NucBlue Live ReadyProbes reagent (Thermo Fisher R37605). Image cells with C2 laser scanning confocal microscope (Nikon).

Results are depicted in images of FIGS. 218-224.

Example 142

Mammalian Cell Expression and Luminescence Assays

Transfection protocol: Preparing cells: Aspirated media from HeLa cells (PKCα-HiBiT clone) that were grown to confluency in a T-150 flask and wash cells with 10 ml DPBS. (Life Technologies 14190). Aspirated DPBS and added 4 ml of TryPLE Express Trypsin (Life Technologies 12604). Incubatde cells for 2-3 minutes at 37° C. then resuspended cells in 16 ml of growth media (DMEM Life Technologies 11995)+10% FBS (VWR 89510-194). Spun cells at 200RPM for 5 minutes. Aspirated supernatant and added 20 ml of DMEM+10% FBS. Counted cells and then diluted to 1,000,000 cells per ml. Plated 1 mL of cells and 3 mL of DMEM+10% FBS in 6 cm dish. Incubated cells for 24 h.

Transfection complex: For each DNA sample to be tested, combined and mixed 10 ug of DNA (1 ug of DNA encoding membrane sensor, and 9 µg of carrier DNA) (Promega E4882) with 400 ul of OptiMem (Life Technologies 11058). Next, added 30 µl of FugeneHD transfection reagent (Promega E2311) and incubated transfection complex for 10 min at ambient temperature. Added transfection complex to 6 cm dish containing plated cells. Incubated cells for 24 h.

Cell-based luminescence assay: Replated transfected cells to white 96 well assay plate. Aspirated media from transfected cells HeLa cells in 6 cm dish and washed cells with 5 ml DPBS. (Life Technologies 14190). Aspirated DPBS and add 0.75 ml of TryPLE Express Trypsin (Life Technologies 12604). Incubated cells for 2-3 minutes at 37° C. then resuspended cells in 4 ml of growth media (DMEM Life Technologies 11995)+10% FBS (VWR 89510-194). Plated 100p of each sample in 30 wells of a white 96 well assay plate. Incubated cells for another 16-24h.

The following morning, aspirated growth media and replaced with 90 µl of C02 independent media (Life Technologies 18045)+10% FBS containing LIX NanoGlo Live Cell Substrate (Promega N2012). Incubated for 10 min. Added 10p of titrated PMA compound to each well. (Final PMA concentration is presented in the graph). Placed plate in a Glomax® Multi+luminometer set to 37° C. and ran a kinetic over the course of 1 hours. Unless otherwise stated, the reported luminescence is the peak height of the kinetic run.

Results depicted in FIGS. 225-227.

Example 143

LgTrip 3546 Optimization

Experiments were conducted during development of embodiments herein to optimize the identity of the amino acid at various positions of LgTrip 3546 (SEQ ID NO: 51), as shown below in Table 20. *E. coli* cultures (200 μl) were prepared for each sample and grown overnight at 37° C. in LB media+100 pg/ml ampicillin. Cultures were then diluted in quadruplicate to a 20× concentration (10 μl in 200 μl) into induction media (LB+ampicllin+0.1% Rhamnose). Samples were grown at 37° C. for 3 hours. Samples were then lysed with 0.3× PLB+25 mM HEPES pH 7.5+0.001U/ml DNase (10 μl of cells to 250 μl of Lysis buffer). 50 μl of the lysate was then combined with 50 μl of NanoGlo® buffer+50 μM furimazine+50 nM of dipeptide 788 (SEQ ID NO: 51). Samples were measured on a BMG Clariostar luminometer. RLU values were normalized to LgTrip 3546 (SEQ ID NO: 51).

TABLE 20

Amino Acid Substitutions for LgTrip 3546 Optimization

```
01         10         20         30         40         50         60         70
||         |          |          |          |          |          |          |
VFTLDDFVGDW EQTAAYNLDQ VLEQGGVSSL LQNLAVSVTP IMRIVRSGEN ALKIDIHVII PYEGLSADQM 71         80         90         100        110        120        130        140
|          |          |          |          |          |          |          |
AQIEEVFKVV YPVDDHHFKV ILPYGTLVID GVTPNKLNYF GRPYEGIAVF DGKKITTTGT LWNGNKIIDE 141 146
|   |
RLITPD
```

| Amino acid substitution | Fold-improvement over 3546 |
|---|---|
| V0D | 1.90 |
| T13E | 2.62 |
| S28P | 2.12 |
| S29G | 1.83 |
| S29P | 2.02 |
| L30F | 1.66 |
| L30T | 1.65 |
| L30Y | 1.95 |
| T39K | 1.81 |
| K53S | 1.58 |
| Y62N | 1.46 |
| G64E | 1.88 |
| Y81E | 1.97 |
| H86D | 2.52 |
| H87N | 1.83 |
| K89E | 1.89 |
| Y94I | 2.18 |
| L97V | 1.85 |
| I99A | 1.60 |
| I99L | 1.49 |
| I99M | 1.57 |
| V102E | 1.85 |
| R112H | 2.37 |
| E115D | 2.38 |
| I117Q | 2.06 |
| I117T | 1.76 |
| V119A | 1.66 |
| V119D | 1.72 |
| V119E | 1.62 |
| V119G | 1.81 |
| V119N | 1.89 |
| K123E | 1.95 |
| K123G | 1.57 |
| W132P | 1.96 |
| L142C | 1.93 |
| T144D | 1.81 |
| P145D | 1.48 |

Sequences

The following polypeptide sequences each comprise an N-terminal methionine residue or corresponding ATG codon; polypeptide sequences lacking the N-terminal methionine residue or corresponding ATG codon are also within the scope herein and are incorporated herein by reference.

The following peptide sequences (and the peptide sequences of Table 1) each lack an N-terminal methionine residue; peptide sequences comprising an N-terminal methionine residue are also within the scope herein and are incorporated herein by reference.

Some embodiments described herein make reference to a His-tagged (or non-His-tagged) sequence within Table 1; alternative embodiments utilizing a non-His-tagged (or His-tagged) version of the sequence, either appearing in Table 1 or not listed, are within the scope herein.

TABLE 1

Exemplary peptide, dipeptide, and polypeptide sequences.

| SEQ ID NO | Name | Sequence |
| --- | --- | --- |
| 1 | WT OgLuc | MFTLADFVGDWQQTAGYNQDQVLEQGGLSSLFQALGV SVTPIQKVVLSGENGLKADIHVIIPYEGLSGFQMGLIEMIF KVVYPVDDHHFKIILHYGTLVIDGVTPNMIDYFGRPYPGI AVFDGKQITVTGTLWNGNKIYDERLINPDGSLLFRVTIN GVTGWRLCENILA |
| 2 | WT OgLuc | atggtgtttaccttggcagatttcgttggagactggcaacagacagctggatacaaccaag atcaagtgttagaacaaggaggattgtctagtctgttccaagccctgggagtgtcagtcac cccaatccagaaagttgtgctgtctggggagaatgggttaaaagctgatattcatgtcatca tcccttacgagggactcagtggttttcaaatgggtctgattgaaatgatcttcaaagttgttta cccagtggatgatcatcatttcaagattattctccattatggtacactcgttattgacggtgtg acaccaaacatgattgactactttggacgccctaccctggaattgctgtgtttgacggcaa gcagatcacagttactggaactctgtggaacggcaacaagatctatgatgagcgcctgat caacccagatggttcactcctcttccgcgttactatcaatggagtcaccggatggcgccttt gcgagaacattcttgcc |
| 3 | NanoLuc® | MKHHHHHHAIAMVFTLEDFVGDWRQTAGYNLDQVLEQ GGVSSLFQNLGVSVTPIQRIVLSGENGLKIDIHVIIPYEGLS GDQMGQIEKIFKVVYPVDDHHFKVILHYGTLVIDGVTPN MIDYFGRPYEGIAVFDGKKITVTGTLWNGNKIIDERLINP DGSLLFRVTINGVTGWRLCERILAV |
| 4 | NanoLuc® | atgaaacatcaccatcaccatcatgcgatcgccatggtcttcacactcgaagatttcgttgg ggactggcgacagacagccggctacaacctggaccaagtccttgaacaggaggtgtg tccagtttgtttcagaatctcggggtgtccgtaactccgatccaaaggattgtcctgagcgg tgaaaatgggctgaagatcgacatccatgtcatcatcccgtatgaaggtctgagcggcga ccaaatgggccagatcgaaaaaattttttaaggtggtgtaccctgtggatgatcatcacttta aggtgatcctgcactatggcacactggtaatcgacggggttacgccaacatgatcgact atttcggacggccgtatgaaggcatcgccgtgttcgacggcaaaaagatcactgtaacag ggaccctgtggaacggcaacaaaattatcgacgagcgcctgatcaaccccgacggctcc ctgctgttccgagtaaccatcaacggagtgaccggctggcggctgtgcgaacgcattctg gcggtt |
| 5 | WT OgLuc Lg | MFTLADFVGDWQQTAGYNQDQVLEQGGLSSLFQALGV SVTPIQKVVLSGENGLKADIHVIIPYEGLSGFQMGLIEMIF KVVYPVDDHHFKIILHYGTLVIDGVTPNMIDYFGRPYPGI AVFDGKQITVTGTLWNGNKIYDERLINPD |
| 6 | WT OgLuc β9 | GSLLFRVTIN |
| 7 | WT OgLuc β10 | GVTGWRLCENILA |
| 8 | WT NanoLuc® Lg | MVFTLEDFVGDWRQTAGYNLDQVLEQGGVSSLFQNLG VSVTPIQRIVLSGENGLKIDIHVIIPYEGLSGDQMGQIEKIF KVVYPVDDHHFKVILHYGTLVIDGVTPNMIDYFGRPYEG IAVFDGKKITVTGTLWNGNKIIDERLINPD |
| 9 | WT NanoLuc® β9 | GSLLFRVTINV |
| 10 | WT NanoLuc® β10 | GVTGWRLCERILA |
| 11 | LgBit | MVFTLEDFVGDWEQTAAYNLDQVLEQGGVSSLLQNLA VSVTPIQRIVRSGENALKIDIHVIIPYEGLSADQMAQIEEV FKVVYPVDDHHFKVILPYGTLVIDGVTPNMLNYFGRPYE GIAVFDGKKITVTGTLWNGNKIIDERLITPDGSMLFRVTI NSHHHHHH |
| 12 | LgBit | atggtcttcacactcgaagatttcgttggggactgggaacagacagccgcctacaacctg gaccaagtccttgaacaggaggtgtgtccagtttgctgcagaatctcgccgtgtccgtaa ctccgatccaaaggattgtccggagcggtgaaaatgccctgaagatcgacatccatgtca tcatcccgtatgaaggtctgagcgccgaccaaatggcccagatcgaagaggtgtttaagg tggtgtaccctgtggatgatcatcacttttaaggtgatcctgccctatggcacactggtaatcg |

TABLE 1-continued

Exemplary peptide, dipeptide, and polypeptide sequences.

| SEQ ID NO | Name | Sequence |
|---|---|---|
| | | acggggttacgccgaacatgctgaactatttcggacggccgtatgaaggcatcgccgtgt<br>tcgacggcaaaaagatcactgtaacagggaccctgtggaacggcaacaaaattatcgac<br>gagcgcctgatcacccccgacggctccatgctgttccgagtaaccatcaacagccatcat<br>caccatcaccac |
| 13 | SmBit | VTGYRLFEEIL |
| 14 | SmBit | gtgaccggctaccggctgttcgaggagattctg |
| 15 | HiBit | VSGWRLFKKIS |
| 16 | HiBit | gtgagcggctggcggctgttcaagaagattagc |
| 17 | LgTrip 2098 | MVFTLEDFVGDWEQTAAYNLDQVLEQGGVSSLLQNLA<br>VSVTPIQRIVRSGENALKIDIHVIIPYEGLSADQMAQIEEV<br>FKVVYPVDDHHFKVILPYGTLVIDGVTPNMLNYFGRPYE<br>GIAVFDGKKITVTGTLWNGNKIIDERLITPD |
| 18 | LgTrip 2098 | atggtcttcacactcgaagatttcgttggggactgggaacagacagccgcctacaacctg<br>gaccaagtccttgaacaggagggtgtgtccagtttgctgcagaatctcgccgtgtccgtaa<br>ctccgatccaaaggattgtccggagcggtgaaaatgCcctgaagatcgacatccatgtca<br>tcatcccgtatgaaggtctgagcgccgaccaaatggcccagatcgaagaggtgtttaagg<br>tggtgtaccctgtggatgatcatcactttaaggtgatcctgccctatggcacactggtaatcg<br>acggggttacgccgaacatgctgaactatttcggacggccgtatgaaggcatcgccgtgt<br>tcgacggcaaaaagatcactgtaacagggaccctgtggaacggcaacaaaattatcgac<br>gagcgcctgatcacccccgac |
| 19 | LgTrip 3092 His | MKHHHHHHVFTLDDFVGDWEQTAAYNLDQVLEQGGV<br>SSLLQNLAVSVTPIMRIVRSGENALKIDIHVIIPYEGLSAD<br>QMAQIEEVFKVVYPVDDHHFKVILPYGTLVIDGVTPNKL<br>NYFGRPYEGIAVFDGKKITVTGTLWNGNKIIDERLITPD |
| 20 | LgTrip 3092 His | atgaaacatcaccatcaccatcatgtcttcacactcgaagatttcgttggggactgggaaca<br>gacagccgcctacaacctggaccaagtccttgaacaggagggtgtgtccagtttgctgca<br>gaatctcgccgtgtccgtaactccgatccaaaggattgtccggagcggtgaaaatgccct<br>gaagatcgacatccatgtcatcatcccgtatgaaggtctgagcgccgaccaaatggccca<br>gatcgaagaggtgtttaaggtggtgtaccctgtggatgatcatcactttaaggtgatcctgc<br>cctatggcacactggtaatcgacggggttacgccgaacatgctgaactatttcggacggc<br>cgtatgaaggcatcgccgtgttcgacggcaaaaagatcactgtaacagggaccctgtgg<br>aacggcaacaaaattatcgacgagcgcctgatcacccccgac |
| 21 | LgTrip 3092 | MVFTLDDFVGDWEQTAAYNLDQVLEQGGVSSLLQNLA<br>VSVTPIMRIVRSGENALKIDIHVIIPYEGLSADQMAQIEEV<br>FKVVYPVDDHHFKVILPYGTLVIDGVTPNKLNYFGRPYE<br>GIAVFDGKKITVTGTLWNGNKIIDERLITPD |
| 22 | LgTrip 3092 | atggtcttcacactcgacgatttcgttggggactgggaacagacagccgcctacaacctg<br>gaccaagtccttgaacaggagggtgtgtccagtttgctgcagaatctcgccgtgtccgtaa<br>ctccgatcatgaggattgtccggagcggtgaaaatgccctgaagatcgacatccatgtcat<br>catcccgtatgaaggtctgagcgccgaccaaatggcccagatcgaagaggtgtttaaggt<br>ggtgtaccctgtggatgatcatcacttttaaggtgatcctgccctatggcacactggtaatcg<br>acggggttacgccgaacaagctgaactatttcggacggccgtatgaaggcatcgccgtgt<br>tcgacggcaaaaagatcactgtaacagggaccctgtggaacggcaacaaaattatcgac<br>gagcgcctgatcacccccgac |
| 23 | SmTrip9 | GSMLFRVTINS |
| 24 | SmTrip9 | ggctccatgctgttccgagtaaccatcaacagc |
| 25 | SmHiTrip10 | VSGWRLFKKIS |
| 26 | SmHiTrip10 | gtgagcggctggcggctgttcaagaagattagc |
| 27 | 5P-B9 | MVFTLEDFVGDWEQTAAYNLDQVLEQGGVSSLFQNLA<br>VSVTPIQRIVLSGENALKIDIHVIIPYEGLSADQMAQIEKIF<br>KVVYPVDDHHFKVILHYGTLVIDGVTPNMINYFGRPYEG<br>IAVFDGKKITVTGTLWNGNKIIDERLITPD |
| 28 | 5P-B9 | atggtcttcacactcgaagatttcgttggggactgggaacagacagccgcctacaacctg<br>gaccaagtccttgaacaggagggtgtgtccagtttgtttcagaatctcgccgtgtccgtaac<br>tccgatccaaaggattgtcctgagcggtgaaaatgccctgaagatcgacatccatgtcatc<br>atcccgtatgaaggtctgagcgccgaccaaatggcccagatcgaaaaaatttttaaggtg<br>gtgtaccctgtggatgatcatcactttaaggtgatcctgcactatggcacactggtaatcga<br>cggggttacgccgaacatgatcaactatttcggacggccgtatgaaggcatcgccgtgtt |

TABLE 1-continued

Exemplary peptide, dipeptide, and polypeptide sequences.

| SEQ ID NO | Name | Sequence |
|---|---|---|
| | | cgacggcaaaaagatcactgtaacagggaccctgtggaacggcaacaaaattatcgacg<br>agcgcctgatcacccccgac |
| 29 | 5P(147-157) | GSMLFRVTINV |
| 30 | 5P(147-157) | ggctccatgctgttccgagtaaccatcaac |
| 31 | LgTrip 2098 His | MKHHHHHHVFTLEDFVGDWEQTAAYNLDQVLEQGGVS<br>SLLQNLAVSVTPIQRIVRSGENALKIDIHVIIPYEGLSADQ<br>MAQIEEVFKVVYPVDDHHFKVILPYGTLVIDGVTPNMLN<br>YFGRPYEGIAVFDGKKITVTGTLWNGNKIIDERLITPD |
| 32 | LgTrip 2098 His | atgaaacatcaccatcaccatcatgtcttcacactcgaagatttcgttggggactgggaaca<br>gacagccgcctacaacctggaccaagtccttgaacagggaggtgtgtccagtttgctgca<br>gaatctcgccgtgtccgtaactccgatccaaaggattgtccggagcggtgaaaatgccct<br>gaagatcgacatccatgtcatcatcccgtatgaaggtctgagcgccgaccaaatggccca<br>gatcgaagaggtgtttaaggtggtgtaccctgtggatgatcatcactttaaggtgatcctgc<br>cctatggcacactggtaatcgacggggttacgccgaacatgctgaactatttcggacggc<br>cgtatgaaggcatcgccgtgttcgacggcaaaaagatcactgtaacagggaccctgtgg<br>aacggcaacaaaattatcgacgagcgcctgatcacccccgac |
| 35 | SmTrip9/10 Dipeptide (pep263) | GSMLFRVTINSVSGWRLFKKIS |
| 36 | SmTrip9/10 Dipeptide (pep263) | ggctccatgctgttccgagtaaccatcaacagcgtgagcggctggcggctgttcaagaag<br>attagc |
| 37 | SmTrip9+ (pep286) | SSWKRGSMLFRVTINS |
| 38 | SmTrip9+ (pep286) | Agcagctggaagcgcggctccatgctgttccgagtaaccatcaacagc |
| 39 | LgTrip 3440 | MKHHHHHHVFTLDDFVGDWEQTAAYNLDQVLEQGGV<br>SSLLQNLAVSVTPIMRIVRSGENALKIDIHVIIPYEGLSAD<br>QMAQIEEVFKVVYPVDDHHFKVILPYGTLVIDGDTPNKL<br>NYFGRPYDGIAVFDGKKITVTGTLWNGNKIIDERLITPD |
| 40 | LgTrip 3440 | atgaaacatcaccatcaccatcatgtcttcacactcgacgatttcgttggggactgggaaca<br>gacagccgcctacaacctggaccaagtccttgaacagggaggtgtgtccagtttgctgca<br>gaatctcgccgtgtccgtaactccgatcatgaggattgtccggagcggtgaaaatgccct<br>gaagatcgacatccatgtcatcatcccgtatgaaggtctgagcgccgaccaaatggccca<br>gatcgaagaggtgtttaaggtggtgtaccctgtggatgatcatcactttaaggtgatcctgc<br>cctatggcacactggtaatcgacggggatacgccgaacaagctgaactatttcggacgg<br>ccgtatgatggcatcgccgtgttcgacggcaaaaagatcactgtaacagggaccctgtgg<br>aacggcaacaaaattatcgacgagcgcctgatcacccccgac |
| 41 | LgTrip 3121 | MKHHHHHHVFTLDDFVGDWEQTAAYNLDQVLEQGGV<br>SSLLQNLAVSVTPIMRIVRSGENALKIDIHVIIPYEGLSAD<br>QMAQIEEVFKVVYPVDDHHFKVILPYGTLVIDGVTPSKL<br>NYFGRPYEGIAVFDGKKITVTGTLWNGNKIIDERLITPD |
| 42 | LgTrip 3121 | atgaaacatcaccatcaccatcatgtcttcacactcgacgatttcgttggggactgggaaca<br>gacagccgcctacaacctggaccaagtccttgaacagggaggtgtgtccagtttgctgca<br>gaatctcgccgtgtccgtaactccgatcatgaggattgtccggagcggtgaaaatgccct<br>gaagatcgacatccatgtcatcatcccgtatgaaggtctgagcgccgaccaaatggccca<br>gatcgaagaggtgtttaaggtggtgtaccctgtggatgatcatcactttaaggtgatcctgc<br>cctatggcacactggtaatcgacggggttacgccgagcaagctgaactatttcggacggc<br>cgtatgaaggcatcgccgtgttcgacggcaaaaagatcactgtaacagggaccctgtgg<br>aacggcaacaaaattatcgacgagcgcctgatcacccccgac |
| 43 | LgTrip 3482 | MKHHHHHHVFTLDDFVGDWEQTAAYNLDQVLEQGGV<br>SSLLQNLAVSVTPIMRIVRSGENALKIDIHVIIPYEGLSAD<br>QMAQIEEVFKVVYPVDDHHFKVILPYGTLVIDGVTPNKL<br>NYFGRPYEGFAVFDGKKITVTGTLWNGNKIIDERLITPD |
| 44 | LgTrip 3482 | atgaaacatcaccatcaccatcatgtcttcacactcgacgatttcgttggggactgggaaca<br>gacagccgcctacaacctggaccaagtccttgaacagggaggtgtgtccagtttgctgca<br>gaatctcgccgtgtccgtaactccgatcatgaggattgtccggagcggtgaaaatgccct<br>gaagatcgacatccatgtcatcatcccgtatgaaggtctgagcgccgaccaaatggccca<br>gatcgaagaggtgtttaaggtggtgtaccctgtggatgatcatcactttaaggtgatcctgc<br>cctatggcacactggtaatcgacggggttacgccgaacaagctgaactatttcggacggc |

TABLE 1-continued

Exemplary peptide, dipeptide, and polypeptide sequences.

| SEQ ID NO | Name | Sequence |
|---|---|---|
| | | cgtatgaaggcttcgccgtgttcgacggcaaaaagatcactgtaacagggaccctgtgga<br>acggcaacaaaattatcgacgagcgcctgatcaccccgac |
| 45 | LgTrip 3497 | MKHHHHHHVFTLDDFVGDWEQTAAYNLDQVLEQGGV<br>SSLLQNLAVSVTPIMRIVRSGENALKIDIHVIIPYEGLSAD<br>QMAQIEEVFKVVYPVDDHHFKVILPYGTLVIDGVTPNKL<br>NYFGRPYEGIAVCDGKKITVTGTLWNGNKIIDERLITPD |
| 46 | LgTrip 3497 | atgaaacatcaccatcaccatcatgtcttcacactcgacgatttcgttggggactgggaaca<br>gacagccgcctacaacctggaccaagtccttgaacagggaggtgtgtccagtttgctgca<br>gaatctcgccgtgtccgtaactccgatcatgaggattgtccggagcggtgaaaatgccct<br>gaagatcgacatccatgtcatcatcccgtatgaaggtctgagcgccgaccaaatggccca<br>gatcgaagaggtgtttaaggtggtgtaccctgtggatgatcatcactttaaggtgatcctgc<br>cctatggcacactggtaatcgacggggttacgccgaacaagctgaactatttcggacggc<br>cgtatgaaggcatcgccgtgtgcgacggcaaaaagatcactgtaacagggaccctgtgg<br>aacggcaacaaaattatcgacgagcgcctgatcaccccgac |
| 47 | LgTrip 3125 | MKHHHHHHVFTLDDFVGDWEQTAAYNLDQVLEQGGV<br>SSLLQNLAVSVTPIMRIVRSGENALKIDIHVIIPYEGLSAD<br>QMAQIEEVFKVVYPVDDHHFKVILPYGTLVIDGVTPNKL<br>NYFGRPYEGIAVFDGKKISVTGTLWNGNKIIDERLITPD |
| 48 | LgTrip 3125 | atgaaacatcaccatcaccatcatgtcttcacactcgacgatttcgttggggactgggaaca<br>gacagccgcctacaacctggaccaagtccttgaacagggaggtgtgtccagtttgctgca<br>gaatctcgccgtgtccgtaactccgatcatgaggattgtccggagcggtgaaaatgccct<br>gaagatcgacatccatgtcatcatcccgtatgaaggtctgagcgccgaccaaatggccca<br>gatcgaagaggtgtttaaggtggtgtaccctgtggatgatcatcactttaaggtgatcctgc<br>cctatggcacactggtaatcgacggggttacgccgaacaagctgaactatttcgggcggc<br>cgtatgaaggcatcgccgtgttcgacggcaaaaagatctctgtaacagggaccctgtgga<br>acggcaacaaaattatcgacgagcgcctgatcaccccgac |
| 49 | LgTrip 3118 | MKHHHHHHVFTLDDFVGDWEQTAAYNLDQVLEQGGV<br>SSLLQNLAVSVTPIMRIVRSGENALKIDIHVIIPYEGLSAD<br>QMAQIEEVFKVVYPVDDHHFKVILPYGTLVIDGVTPNKL<br>NYFGRPYEGIAVFDGKKITATGTLWNGNKIIDERLITPD |
| 50 | LgTrip 3118 | atgaaacatcaccatcaccatcatgtcttcacactcgacgatttcgttggggactgggaaca<br>gacagccgcctacaacctggaccaagtccttgaacagggaggtgtgtccagtttgctgca<br>gaatctcgccgtgtccgtaactccgatcatgaggattgtccggagcggtgaaaatgccct<br>gaagatcgacatccatgtcatcatcccgtatgaaggtctgagcgccgaccaaatggccca<br>gatcgaagaggtgtttaaggtggtgtaccctgtggatgatcatcactttaaggtgatcctgc<br>cctatggcacactggtaatcgacggggttacgccgaacaagctgaactatttcggacggc<br>cgtatgaaggcatcgccgtgttcgacggcaaaaagatcactgcaacagggaccctgtgg<br>aacggcaacaaaattatcgacgagcgcctgatcaccccgac |
| 51 | LgTrip 3546 | MKHHHHHHVFTLDDFVGDWEQTAAYNLDQVLEQGGV<br>SSLLQNLAVSVTPIMRIVRSGENALKIDIHVIIPYEGLSAD<br>QMAQIEEVFKVVYPVDDHHFKVILPYGTLVIDGVTPNKL<br>NYFGRPYEGIAVFDGKKITTTGTLWNGNKIIDERLITPD |
| 52 | LgTrip 3546 | atgaaacatcaccatcaccatcatgtcttcacactcgacgatttcgttggggactgggaaca<br>gacagccgcctacaacctggaccaagtccttgaacagggaggtgtgtccagtttgctgca<br>gaatctcgccgtgtccgtaactccgatcatgaggattgtccggagcggtgaaaatgccct<br>gaagatcgacatccatgtcatcatcccgtatgaaggtctgagcgccgaccaaatggccca<br>gatcgaagaggtgtttaaggtggtgtaccctgtggatgatcatcactttaaggtgatcctgc<br>cctatggcacactggtaatcgacggggttacgccgaacaagctgaactatttcggacggc<br>cgtatgaaggcatcgccgtgttcgacggcaaaaagatcactaccacagggaccctgtgg<br>aacggcaacaaaattatcgacgagcgcctgatcaccccgac |
| 53 | LgTrip 3546+G (ATG 3572) | MVFTLDDFVGDWEQTAAYNLDQVLEQGGVSSLLQNLA<br>VSVTPIMRIVRSGENALKIDIHVIIPYEGLSADQMAQIEEV<br>FKVVYPVDDHHFKVILPYGTLVIDGVTPNKLNYFGRPYE<br>GIAVFDGKKITTTGTLWNGNKIIDERLITPDG |
| 54 | LgTrip 3546+G (ATG 3572) | atggtcttcacactcgacgatttcgttggggactgggaacagacagccgcctacaacctg<br>gaccaagtccttgaacagggaggtgtgtccagtttgctgcagaatctcgccgtgtccgtaa<br>ctccgatcatgaggattgtccggagcggtgaaaatgcccgaagatcgacatccatgtcat<br>catcccgtatgaaggtctgagcgccgaccaaatggcccagatcgaagaggtgtttaaggt<br>ggtgtaccctgtggatgatcatcactttaaggtgatcctgccctatggcacactggtaatcg<br>acgggttacgccgaacaagctgaactatttcggacggccgtatgaaggcatcgccgtgt<br>tcgacggcaaaaagatcactaccacagggaccctgtggaacggcaacaaaattatcgac<br>gagcgcctgatcaccccgacggc |

TABLE 1-continued

Exemplary peptide, dipeptide, and polypeptide sequences.

| SEQ ID NO | Name | Sequence |
|---|---|---|
| 55 | LgTrip 3546-D (ATG 3573) | MVFTLDDFVGDWEQTAAYNLDQVLEQGGVSSLLQNLA VSVTPIMRIVRSGENALKIDIHVIIPYEGLSADQMAQIEEV FKVVYPVDDHHFKVILPYGTLVIDGVTPNKLNYFGRPYE GIAVFDGKKITTTGTLWNGNKIIDERLITP |
| 56 | LgTrip 3546-D (ATG 3573) | atggtcttcacactcgacgatttcgttggggactgggaacagacagccgcctacaacctg gaccaagtccttgaacaggaggtgtgtccagtttgctgcagaatctcgccgtgtccgtaa ctccgatcatgaggattgtccggagcggtgaaaatgccctgaagatcgacatccatgtcat catcccgtatgaaggtctgagcgccgaccaaatggcccagatcgaagaggtgtttaaggt ggtgtaccctgtggatgatcatcacttttaaggtaatcctgccctatggcacactggtaatcg acgggggttacgccgaacaagctgaactatttcggacggccgtatgaaggcatcgccgtgt tcgacggcaaaaagatcactaccacagggaccctgtggaacggcaacaaaattatcgac gagcgcctgatcaccccc |
| 57 | LgTrip 3546-PD (ATG 3574) | MVFTLDDFVGDWEQTAAYNLDQVLEQGGVSSLLQNLA VSVTPIMRIVRSGENALKIDIHVIIPYEGLSADQMAQIEEV FKVVYPVDDHHFKVILPYGTLVIDGVTPNKLNYFGRPYE GIAVFDGKKITTTGTLWNGNKIIDERLIT |
| 58 | LgTrip 3546-PD (ATG 3574) | atggtcttcacactcgacgatttcgttggggactgggaacagacagccgcctacaacctg gaccaagtccttgaacaggaggtgtgtccagtttgctgcagaatctcgccgtgtccgtaa ctccgatcatgaggattgtccggagcggtgaaaatgccctgaagatcgacatccatgtcat catcccgtatgaaggtctgagcgccgaccaaatggcccagatcgaagaggtgtttaaggt ggtgtaccctgtggatgatcatcacttttaaggtgatcctgccctatggcacactggtaatcg acgggggttacgccgaacaagctgaactatttcggacggccgtatgaaggcatcgccgtgt tcgacggcaaaaagatcactaccacagggaccctgtggaacggcaacaaaattatcgac gagcgcctgatcacc |
| 59 | LgTrip 3546+GS (ATG 3575) | MVFTLDDFVGDWEQTAAYNLDQVLEQGGVSSLLQNLA VSVTPIMRIVRSGENALKIDIHVIIPYEGLSADQMAQIEEV FKVVYPVDDHHFKVILPYGTLVIDGVTPNKLNYFGRPYE GIAVFDGKKITTTGTLWNGNKIIDERLITPDGS |
| 60 | LgTrip 3546+GS (ATG 3575) | atggtcttcacactcgacgatttcgttggggactgggaacagacagccgcctacaacctg gaccaagtccttgaacaggaggtgtgtccagtttgctgcagaatctcgccgtgtccgtaa ctccgatcatgaggattgtccggagcggtgaaaatgccctgaagatcgacatccatgtcat catcccgtatgaaggtctgagcgccgaccaaatggcccagatcgaagaggtgtttaaggt ggtgtaccctgtggatgatcatcacttttaaggtgatcctgccctatggcacactggtaatcg acgggggttacgccgaacaagctgaactatttcggacggccgtatgaaggcatcgccgtgt tcgacggcaaaaagatcactaccacagggaccctgtggaacggcaacaaaattatcgac gagcgcctgatcaccccccgacggcagc |
| 61 | -V_LgBiT (ATG3618) | MFTLEDFVGDWEQTAAYNLDQVLEQGGVSSLLQNLAV SVTPIQRIVRSGENALKIDIHVIIPYEGLSADQMAQIEEVF KVVYPVDDHHFKVILPYGTLVIDGVTPNMLNYFGRPYE GIAVFDGKKITVTGTLWNGNKIIDERLITPDGSMLFRVTI NSHHHHHH |
| 62 | -V_LgBiT (ATG3618) | atgttcacactcgaagatttcgttggggactgggaacagacagccgcctacaacctggac caagtccttgaacaggaggtgtgtccagtttgctgcagaatctcgccgtgtccgtaactc cgatccaaaggattgtccggagcggtgaaaatgccctgaagatcgacatccatgtcatca tcccgtatgaaggtctgagcgccgaccaaatggcccagatcgaagaggtgtttaaggtg gtgtaccctgtggatgatcatcacttttaaggtgatcctgccctatggcacactggtaatcga cgggggttacgccgaacatgctgaactatttcggacggccgtatgaaggcatcgccgtgtt cgacggcaaaaagatcactgtaacaggaccctgtggaacggcaacaaaattatcgacg agcgcctgatcaccccccgacggctccatgctgttccgagtaaccatcaacagccatcatc accatcaccactaa |
| 63 | -VF_LgBiT (ATG3619) | MTLEDFVGDWEQTAAYNLDQVLEQGGVSSLLQNLAVS VTPIQRIVRSGENALKIDIHVIIPYEGLSADQMAQIEEVFK VVYPVDDHHFKVILPYGTLVIDGVTPNMLNYFGRPYEGI AVFDGKKITVTGTLWNGNKIIDERLITPDGSMLFRVTINS HHHHHH |
| 64 | -VF_LgBiT (ATG3619) | atgacactcgaagatttcgttggggactgggaacagacagccgcctacaacctggacca agtccttgaacaggaggtgtgtccagtttgctgcagaatctcgccgtgtccgtaactccg atccaaaggattgtccggagcggtgaaaatgccctgaagatcgacatccatgtcatcatcc cgtatgaaggtctgagcgccgaccaaatggcccagatcgaagaggtgtttaaggtggtgt accctgtggatgatcatcacttttaaggtgatcctgccctatggcacactggtaatcgacgg ggttacgccgaacatgctgaactatttcggacggccgtatgaaggcatcgccgtgttcga cggcaaaaagatcactgtaacaggaccctgtggaacggcaacaaaattatcgacgagc gcctgatcaccccccgacggctccatgctgttccgagtaaccatcaacagccatcatcacc atcaccactaa |

TABLE 1-continued

Exemplary peptide, dipeptide, and polypeptide sequences.

| SEQ ID NO | Name | Sequence |
|---|---|---|
| 65 | -VFT_LgBiT (ATG3620) | MLEDFVGDWEQTAAYNLDQVLEQGGVSSLLQNLAVSV TPIQRIVRSGENALKIDIHVIIPYEGLSADQMAQIEEVFKV VYPVDDHHFKVILPYGTLVIDGVTPNMLNYFGRPYEGIA VFDGKKITVTGTLWNGNKIIDERLITPDGSMLFRVTINSH HHHHH |
| 66 | -VFT_LgBiT (ATG3620) | atgctcgaagatttcgttggggactgggaacagacagccgcctacaacctggaccaagt ccttgaacagggaggtgtgtccagtttgctgcagaatctcgccgtgtccgtaactccgatc caaaggattgtccggagcggtgaaaatgccctgaagatcgacatccatgtcatcatcccg tatgaaggtctgagcgccgaccaaatggcccagatcgaagaggtgtttaaggtggtgtac cctgtggatgatcatcactttaaggtgatcctgccctatggcacactggtaatcgacggggt tacgccgaacatgctgaactatttcggacggccgtatgaaggcatcgccgtgttcgacgg caaaaagatcactgtaacagggaccctgtggaacggcaacaaaattatcgacgagcgcc tgatcaccccgacggctccatgctgttccgagtaaccatcaacagccatcatcaccatca ccactaa |
| 67 | -VFTL_LgBiT (ATG3621) | MEDFVGDWEQTAAYNLDQVLEQGGVSSLLQNLAVSVT PIQRIVRSGENALKIDIHVIIPYEGLSADQMAQIEEVFKVV YPVDDHHFKVILPYGTLVIDGVTPNMLNYFGRPYEGIAV FDGKKITVTGTLWNGNKIIDERLITPDGSMLFRVTINSHH HHHH |
| 68 | -VFTL_LgBiT (ATG3621) | atggaagatttcgttggggactgggaacagacagccgcctacaacctggaccaagtcctt gaacagggaggtgtgtccagtttgctgcagaatctcgccgtgtccgtaactccgatccaaa ggattgtccggagcggtgaaaatgccctgaagatcgacatccatgtcatcatcccgtatga aggtctgagcgccgaccaaatggcccagatcgaagaggtgtttaaggtggtgtaccctgt ggatgatcatcactttaaggtgatcctgccctatggcacactggtaatcgacggggttacg ccgaacatgctgaactatttcggacggccgtatgaaggcatcgccgtgttcgacggcaaa aagatcactgtaacagggaccctgtggaacggcaacaaaattatcgacgagcgcctgat cacccccgacggctccatgctgttccgagtaaccatcaacagccatcatcaccatcacca ctaa |
| 69 | (M)FKKIS-GSSG-LgBiT (ATG3632) | MFKKISGSSGVFTLEDFVGDWEQTAAYNLDQVLEQGGV SSLLQNLAVSVTPIQRIVRSGENALKIDIHVIIPYEGLSAD QMAQIEEVFKVVYPVDDHHFKVILPYGTLVIDGVTPNML NYFGRPYEGIAVFDGKKITVTGTLWNGNKIIDERLITPDG SMLFRVTINSHHHHHH |
| 70 | (M)FKKIS-GSSG-LgBiT (ATG3632) | atgttcaagaagattagcggctcgagcggtgtcttcacactcgaagatttcgttggggact gggaacagacagccgcctacaacctggaccaagtccttgaacagggaggtgtgtccagt ttgctgcagaatctcgccgtgtccgtaactccgatccaaaggattgtccggagcggtgaaa atgccctgaagatcgacatccatgtcatcatcccgtatgaaggtctgagcgccgaccaaat ggcccagatcgaagaggtgtttaaggtggtgtaccctgtggatgatcatcactttaaggtg atcctgccctatggcacactggtaatcgacggggttacgccgaacatgctgaactatttcg gacggccgtatgaaggcatcgccgtgttcgacggcaaaaagatcactgtaacagggacc ctgtggaacggcaacaaaattatcgacgagcgcctgatcaccccgacggctccatgct gttccgagtaaccatcaacagccatcatcaccatcaccactaa |
| 71 | (M)KKIS-GSSG-LgBiT (ATG3633) | MKKISGSSGVFTLEDFVGDWEQTAAYNLDQVLEQGGVS SLLQNLAVSVTPIQRIVRSGENALKIDIHVIIPYEGLSADQ MAQIEEVFKVVYPVDDHHFKVILPYGTLVIDGVTPNMLN YFGRPYEGIAVFDGKKITVTGTLWNGNKIIDERLITPDGS MLFRVTINSHHHHHH |
| 72 | (M)KKIS-GSSG-LgBiT (ATG3633) | atgaagaagattagcggctcgagcggtgtcttcacactcgaagatttcgttggggactgg gaacagacagccgcctacaacctggaccaagtccttgaacagggaggtgtgtccagtttg ctgcagaatctcgccgtgtccgtaactccgatccaaaggattgtccggagcggtgaaaa tgccctgaagatcgacatccatgtcatcatcccgtatgaaggtctgagcgccgaccaaatg gcccagatcgaagaggtgtttaaggtggtgtaccctgtggatgatcatcactttaaggtgat cctgccctatggcacactggtaatcgacggggttacgccgaacatgctgaactatttcgga cggccgtatgaaggcatcgccgtgttcgacggcaaaaagatcactgtaacagggaccct gtggaacggcaacaaaattatcgacgagcgcctgatcaccccgacggctccatgctgtt ccgagtaaccatcaacagccatcatcaccatcaccactaa |
| 73 | (M)KIS-GSSG-LgBiT (ATG3634) | MKISGSSGVFTLEDFVGDWEQTAAYNLDQVLEQGGVSS LLQNLAVSVTPIQRIVRSGENALKIDIHVIIPYEGLSADQM AQIEEVFKVVYPVDDHHFKVILPYGTLVIDGVTPNMLNY FGRPYEGIAVFDGKKITVTGTLWNGNKIIDERLITPDGSM LFRVTINSHHHHHH |
| 74 | (M)KIS-GSSG-LgBiT (ATG3634) | atgaagattagcggctcgagcggtgtcttcacactcgaagatttcgttggggactgggaac agacagccgcctacaacctggaccaagtccttgaacagggaggtgtgtccagtttgctgc agaatctcgccgtgtccgtaactccgatccaaaggattgtccggagcggtgaaaatgccc |

TABLE 1-continued

Exemplary peptide, dipeptide, and polypeptide sequences.

| SEQ ID NO | Name | Sequence |
|---|---|---|
| | | tgaagatcgacatccatgtcatcatcccgtatgaaggtctgagcgccgaccaaatgccc agatcgaagaggtgtttaaggtggtgtaccctgtggatgatcatcactttaaggtgatcctg ccctatggcacactggtaatcgacggggttacgccgaacatgctgaactatttcggacgg ccgtatgaaggcatcgccgtgttcgacggcaaaaagatcactgtaacagggaccctgtg gaacggcaacaaaattatcgacgagcgcctgatcaccccgacggctccatgctgttcc gagtaaccatcaacagccatcatcaccatcaccactaa |
| 75 | (M)IS-GSSG-LgBiT (ATG3635) | MISGSSGVFTLEDFVGDWEQTAAYNLDQVLEQGGVSSL LQNLAVSVTPIQRIVRSGENALKIDIHVIIPYEGLSADQMA QIEEVFKVVYPVDDHHFKVILPYGTLVIDGVTPNMLNYF GRPYEGIAVFDGKKITVTGTLWNGNKIIDERLITPDGSML FRVTINSHHHHHH |
| 76 | (M)IS-GSSG-LgBiT (ATG3635) | atgattagcggctcgagcggtgtcttcacactcgaagatttcgttggggactgggaacaga cagccgcctacaacctggaccaagtccttgaacagggaggtgtgtccagtttgctgcaga atctcgccgtgtccgtaactccgatccaaaggattgtccggagcggtgaaaatgccctgaag agatcgacatccatgtcatcatcccgtatgaaggtctgagcgccgaccaaatggcccaga tcgaagaggtgtttaaggtggtgtaccctgtggatgatcatcactttaaggtgatcctgccct atggcacactggtaatcgacggggttacgccgaacatgctgaactatttcggacggccgt atgaaggcatcgccgtgttcgacggcaaaaagatcactgtaacagggaccctgtggaac ggcaacaaaattatcgacgagcgcctgatcaccccgacggctccatgctgttccgagta accatcaacagccatcatcaccatcaccactaa |
| 77 | (M)S-GSSG-LgBiT (ATG3636) | MSGSSGVFTLEDFVGDWEQTAAYNLDQVLEQGGVSSLL QNLAVSVTPIQRIVRSGENALKIDIHVIIPYEGLSADQMA QIEEVFKVVYPVDDHHFKVILPYGTLVIDGVTPNMLNYF GRPYEGIAVFDGKKITVTGTLWNGNKIIDERLITPDGSML FRVTINSHHHHHH |
| 78 | (M)S-GSSG-LgBiT (ATG3636) | atgagcggctcgagcggtgtcttcacactcgaagatttcgttggggactgggaacagaca gccgcctacaacctggaccaagtccttgaacagggaggtgtgtccagtttgctgcagaat ctcgccgtgtccgtaactccgatccaaaggattgtccggagcggtgaaaatgccctgaag atcgacatccatgtcatcatcccgtatgaaggtctgagcgccgaccaaatggcccagatc gaagaggtgtttaaggtggtgtaccctgtggatgatcatcactttaaggtgatcctgccctat ggcacactggtaatcgacggggttacgccgaacatgctgaactatttcggacggccgtat gaaggcatcgccgtgttcgacggcaaaaagatcactgtaacagggaccctgtggaacg gcaacaaaattatcgacgagcgcctgatcaccccgacggctccatgctgttccgagtaa ccatcaacagccatcatcaccatcaccactaa |
| 79 | LgTrip + GSM (ATG3722) | MKHHHHHHVFTLDDFVGDWEQTAAYNLDQVLEQGGV SSLLQNLAVSVTPIMRIVRSGENALKIDIHVIIPYEGLSAD QMAQIEEVFKVVYPVDDHHFKVILPYGTLVIDGVTPNKL NYFGRPYEGIAVFDGKKITTTGTLWNGNKIIDERLITPDG SM |
| 80 | LgTrip + GSM (ATG3722) | atgaaacatcaccatcaccatcatgtcttcacactcgacgatttcgttggggactgggaaca gacagccgcctacaacctggaccaagtccttgaacagggaggtgtgtccagtttgctgca gaatctcgccgtgtccgtaactccgatcatgaggattgtccggagcggtgaaaatgccct gaagatcgacatccatgtcatcatcccgtatgaaggtctgagcgccgaccaaatggccc gatcgaagaggtgtttaaggtggtgtaccctgtggatgatcatcactttaaggtgatcctgc cctatggcacactggtaatcgacggggttacgccgaacaagctgaactatttcggacggc cgtatgaaggcatcgccgtgttcgacggcaaaaagatcactaccacagggaccctgtgg aacggcaacaaaattatcgacgagcgcctgatcaccccgacggcagcatgtaa |
| 81 | LgTrip + GSML (ATG3723) | MKHHHHHHVFTLDDFVGDWEQTAAYNLDQVLEQGGV SSLLQNLAVSVTPIMRIVRSGENALKIDIHVIIPYEGLSAD QMAQIEEVFKVVYPVDDHHFKVILPYGTLVIDGVTPNKL NYFGRPYEGIAVFDGKKITTTGTLWNGNKIIDERLITPDG SML |
| 82 | LgTrip + GSML (ATG3723) | atgaaacatcaccatcaccatcatgtcttcacactcgacgatttcgttggggactgggaaca gacagccgcctacaacctggaccaagtccttgaacagggaggtgtgtccagtttgctgca gaatctcgccgtgtccgtaactccgatcatgaggattgtccggagcggtgaaaatgccct gaagatcgacatccatgtcatcatcccgtatgaaggtctgagcgccgaccaaatgccca gatcgaagaggtgtttaaggtggtgtaccctgtggatgatcatcactttaaggtgatcctgc cctatggcacactggtaatcgacggggttacgccgaacaagctgaactatttcggacggc cgtatgaaggcatcgccgtgttcgacggcaaaaagatcactaccacagggaccctgtgg aacggcaacaaaattatcgacgagcgcctgatcaccccgacggcagcatgctgtaa |
| 83 | LgTrip + GSMLF (ATG3724) | MKHHHHHHVFTLDDFVGDWEQTAAYNLDQVLEQGGV SSLLQNLAVSVTPIMRIVRSGENALKIDIHVIIPYEGLSAD QMAQIEEVFKVVYPVDDHHFKVILPYGTLVIDGVTPNKL NYFGRPYEGIAVFDGKKITTTGTLWNGNKIIDERLITPDG SMLF |

TABLE 1-continued

Exemplary peptide, dipeptide, and polypeptide sequences.

| SEQ ID NO | Name | Sequence |
|---|---|---|
| 84 | LgTrip + GSMLF (ATG3724) | atgaaacatcaccatcaccatcatgtcttcacactcgacgatttcgttggggactgggaaca gacagccgcctacaacctggaccaagtccttgaacagggaggtgtgtccagtttgctgca gaatctcgccgtgtccgtaactccgatcatgaggattgtccggagcggtgaaaatgccct gaagatcgacatccatgtcatcatcccgtatgaaggtctgagcgccgaccaaatggccca gatcgaagaggtgtttaaggtggtgtaccctgtggatgatcatcactttaaggtgatcctgc cctatggcacactggtaatcgacggggttacgccgaacaagctgaactatttcggacggc cgtatgaaggcatcgccgtgttcgacggcaaaaagatcactaccacagggaccctgtgg aacggcaacaaaattatcgacgagcgcctgatcaccccgacggcagcatgctgttctaa |
| 85 | LgTrip - TPD (ATG3725) | MKHHHHHHVFTLDDFVGDWEQTAAYNLDQVLEQGGV SSLLQNLAVSVTPIMRIVRSGENALKIDIHVIIPYEGLSAD QMAQIEEVFKVVYPVDDHHFKVILPYGTLVIDGVTPNKL NYFGRPYEGIAVFDGKKITTTGTLWNGNKIIDERLI |
| 86 | LgTrip - TPD (ATG3725) | atgaaacatcaccatcaccatcatgtcttcacactcgacgatttcgttggggactgggaaca gacagccgcctacaacctggaccaagtccttgaacagggaggtgtgtccagtttgctgca gaatctcgccgtgtccgtaactccgatcatgaggattgtccggagcggtgaaaatgccct gaagatcgacatccatgtcatcatcccgtatgaaggtctgagcgccgaccaaatggccca gatcgaagaggtgtttaaggtggtgtaccctgtggatgatcatcactttaaggtgatcctgc cctatggcacactggtaatcgacggggttacgccgaacaagctgaactatttcggacggc cgtatgaaggcatcgccgtgttcgacggcaaaaagatcactaccacagggaccctgtgg aacggcaacaaaattatcgacgagcgcctgatctaa |
| 87 | LgTrip - ITPD (ATG3726) | MKHHHHHHVFTLDDFVGDWEQTAAYNLDQVLEQGGV SSLLQNLAVSVTPIMRIVRSGENALKIDIHVIIPYEGLSAD QMAQIEEVFKVVYPVDDHHFKVILPYGTLVIDGVTPNKL NYFGRPYEGIAVFDGKKITTTGTLWNGNKIIDERL |
| 88 | LgTrip - ITPD (ATG3726) | atgaaacatcaccatcaccatcatgtcttcacactcgacgatttcgttggggactgggaaca gacagccgcctacaacctggaccaagtccttgaacagggaggtgtgtccagtttgctgca gaatctcgccgtgtccgtaactccgatcatgaggattgtccggagcggtgaaaatgccct gaagatcgacatccatgtcatcatcccgtatgaaggtctgagcgccgaccaaatggccca gatcgaagaggtgtttaaggtggtgtaccctgtggatgatcatcactttaaggtgatcctgc cctatggcacactggtaatcgacggggttacgccgaacaagctgaactatttcggacggc cgtatgaaggcatcgccgtgttcgacggcaaaaagatcactaccacagggaccctgtgg aacggcaacaaaattatcgacgagcgcctgtaa |
| 89 | LgTrip - LITPD (ATG3727) | MKHHHHHHVFTLDDFVGDWEQTAAYNLDQVLEQGGV SSLLQNLAVSVTPIMRIVRSGENALKIDIHVIIPYEGLSAD QMAQIEEVFKVVYPVDDHHFKVILPYGTLVIDGVTPNKL NYFGRPYEGIAVFDGKKITTTGTLWNGNKIIDER |
| 90 | LgTrip - LITPD (ATG3727) | atgaaacatcaccatcaccatcatgtcttcacactcgacgatttcgttggggactgggaaca gacagccgcctacaacctggaccaagtccttgaacagggaggtgtgtccagtttgctgca gaatctcgccgtgtccgtaactccgatcatgaggattgtccggagcggtgaaaatgccct gaagatcgacatccatgtcatcatcccgtatgaaggtctgagcgccgaccaaatggccca gatcgaagaggtgtttaaggtggtgtaccctgtggatgatcatcactttaaggtgatcctgc cctatggcacactggtaatcgacggggttacgccgaacaagctgaactatttcggacggc cgtatgaaggcatcgccgtgttcgacggcaaaaagatcactaccacagggaccctgtgg aacggcaacaaaattatcgacgagcgctaa |
| 91 | FRB-15GS-AI-86 (ATG1634) | MVAILWHEMWHEGLEEASRLYFGERNVKGMFEVLEPL HAMMERGPQTLKETSFNQAYGRDLMEAQEWCRKYMK SGNVKDLTQAWDLYYHVFRRISGGSGGGGSGGSSSGGA IVSGWRLFKKIS |
| 92 | FRB-15GS-AI-86 (ATG1634) | atggtggccatcctctggcatgagatgtggcatgaaggcctggaagaggcatctcgtttgt actttggggaaaggaacgtgaaaggcatgtttgaggtgctggagcccttgcatgctatgat ggaacgggggcccccagactctgaaggaaacatcctttaatcaggcctatggtcgagattt aatggagggcccaagagtggtgcaggaagtacatgaaatgtcaaggacctc acccaagcctgggacctctattatcatgtgttccgacgaatcagtggtggttcaggtggtg gcgggagcggtggctcgagcagcggtggagcgatcgtgagcggctggcggctgttca agaagattagctaa |
| 93 | FRB-15GS-AI-289 (ATG3586) | MVAILWHEMWHEGLEEASRLYFGERNVKGMFEVLEPL HAMMERGPQTLKETSFNQAYGRDLMEAQEWCRKYMK SGNVKDLTQAWDLYYHVFRRISGGSGGGGSGGSSSGGA IVSVSGWRLFKKIS |
| 94 | FRB-15GS-AI-289 (ATG3586) | atggtggccatcctctggcatgagatgtggcatgaaggcctggaagaggcatctcgtttgt actttggggaaaggaacgtgaaaggcatgtttgaggtgctggagcccttgcatgctatgat ggaacgggggcccccagactctgaaggaaacatcctttaatcaggcctatggtcgagattt aatggagggcccaagagtggtgcaggaagtacatgaaatcagggaatgtcaaggacctc |

TABLE 1-continued

Exemplary peptide, dipeptide, and polypeptide sequences.

| SEQ ID NO | Name | Sequence |
|---|---|---|
| | | acccaagcctgggacctctattatcatgtgttccgacgaatcagtggtggttcaggtggtg gcgggagcggtggctcgagcagcggtggagcgatcgttagcgttagcggctggcgcct gttcaagaagatcagctaa |
| 95 | FRB-15GS-AI-86-His6 (ATG3743) | MVAILWHEMWHEGLEEASRLYFGERNVKGMFEVLEPL HAMMERGPQTLKETSFNQAYGRDLMEAQEWCRKYMK SGNVKDLTQAWDLYYHVFRRISGGSGGGGSGGSSSGGA IVSGWRLFKKISHHHHHH |
| 96 | FRB-15GS-AI-86-His6 (ATG3743) | atggtggccatcctctggcatgagatgtggcatgaaggcctggaagaggcatctcgtttgt actttggggaaaggaacgtgaaaggcatgtttgaggtgctggagcccttgcatgctatgat ggaacggggccccagactctgaaggaaacatcctttaatcaggcctatggtcgagattt aatggaggcccaagagtggtgcaggaagtacatgaaatcagggaatgtcaaggacctc acccaagcctgggacctctattatcatgtgttccgacgaatcagtggtggttcaggtggtg gcgggagcggtggctcgagcagcggtggagcgatcgtgagcggctggcggctgttca agaagattagccatcatcaccatcaccactaa |
| 97 | FRB-15GS-AI-289-His6 (ATG3744) | MVAILWHEMWHEGLEEASRLYFGERNVKGMFEVLEPL HAMMERGPQTLKETSFNQAYGRDLMEAQEWCRKYMK SGNVKDLTQAWDLYYHVFRRISGGSGGGGSGGSSSGGA IVSVSGWRLFKKISHHHHHH |
| 98 | FRB-15GS-AI-289-His6 (ATG3744) | atggtggccatcctctggcatgagatgtggcatgaaggcctggaagaggcatctcgtttgt actttggggaaaggaacgtgaaaggcatgtttgaggtgctggagcccttgcatgctatgat ggaacggggccccagactctgaaggaaacatcctttaatcaggcctatggtcgagattt aatggaggcccaagagtggtgcaggaagtacatgaaatcagggaatgtcaaggacctc acccaagcctgggacctctattatcatgtgttccgacgaatcagtggtggttcaggtggtg gcgggagcggtggctcgagcagcggtggagcgatcgttagcgtgagcggctggcgg tgttcaagaagattagccatcatcaccatcaccactaa |
| 99 | His6-FRB-5GS-86 (ATG3760) | MKHHHHHHVAILWHEMWHEGLEEASRLYFGERNVKG MFEVLEPLHAMMERGPQTLKETSFNQAYGRDLMEAQE WCRKYMKSGNVKDLTQAWDLYYHVFRRISGGSGGVSG WRLFKKIS |
| 100 | His6-FRB-5GS-86 (ATG3760) | atgaaacatcaccatcaccatcatgtggccatcctctggcatgagatgtggcatgaaggcc tggaagaggcatctcgtttgtactttggggaaaggaacgtgaaaggcatgtttgaggtgct ggagcccttgcatgctatgatggaacggggccccagactctgaaggaaacatcctttaa tcaggcctatggtcgagatttaatggaggcccaagagtggtgcaggaagtacatgaaatc agggaatgtcaaggacctcacccaagcctgggacctctattatcatgtgttccgacgaatc agtggtggttcaggtggtgtgagcggctggcggctgttcaagaagattagctaa |
| 101 | His6-FRB-10GS-86 (ATG3761) | MKHHHHHHVAILWHEMWHEGLEEASRLYFGERNVKG MFEVLEPLHAMMERGPQTLKETSFNQAYGRDLMEAQE WCRKYMKSGNVKDLTQAWDLYYHVFRRISGGSGGGGS GGVSGWRLFKKIS |
| 102 | His6-FRB-10GS-86 (ATG3761) | atgaaacatcaccatcaccatcatgtggccatcctctggcatgagatgtggcatgaaggcc tggaagaggcatctcgtttgtactttggggaaaggaacgtgaaaggcatgtttgaggtgct ggagcccttgcatgctatgatggaacggggccccagactctgaaggaaacatcctttaa tcaggcctatggtcgagatttaatggaggcccaagagtggtgcaggaagtacatgaaatc agggaatgtcaaggacctcacccaagcctgggacctctattatcatgtgttccgacgaatc agtggtggttcaggtggtggcgggagcggtggcgtgagcggctggcggctgttcaaga agattagctaa |
| 103 | His6-FRB-15GS-86 (ATG3762) | MKHHHHHHVAILWHEMWHEGLEEASRLYFGERNVKG MFEVLEPLHAMMERGPQTLKETSFNQAYGRDLMEAQE WCRKYMKSGNVKDLTQAWDLYYHVFRRISGGSGGGGS GGSSSGGVSGWRLFKKIS |
| 104 | His6-FRB-15GS-86 (ATG3762) | atgaaacatcaccatcaccatcatgtggccatcctctggcatgagatgtggcatgaaggcc tggaagaggcatctcgtttgtactttggggaaaggaacgtgaaaggcatgtttgaggtgct ggagcccttgcatgctatgatggaacggggccccagactctgaaggaaacatcctttaa tcaggcctatggtcgagatttaatggaggcccaagagtggtgcaggaagtacatgaaatc agggaatgtcaaggacctcacccaagcctgggacctctattatcatgtgttccgacgaatc agtggtggttcaggtggtggcgggagcggtggctcgagcagcggtggagtgagcggct ggcggctgttcaagaagattagctaa |
| 105 | His6-FRB-5GS-289 (ATG3763) | MKHHHHHHVAILWHEMWHEGLEEASRLYFGERNVKG MFEVLEPLHAMMERGPQTLKETSFNQAYGRDLMEAQE WCRKYMKSGNVKDLTQAWDLYYHVFRRISGGSGGVSV SGWRLFKKIS |

TABLE 1-continued

Exemplary peptide, dipeptide, and polypeptide sequences.

| SEQ ID NO | Name | Sequence |
|---|---|---|
| 106 | His6-FRB-5GS-289 (ATG3763) | atgaaacatcaccatcaccatcatgtggccatcctctggcatgagatgtggcatgaaggcc tggaagaggcatctcgtttgtactttggggaaaggaacgtgaaaggcatgtttgaggtgct ggagcccttgcatgctatgatggaacggggccccagactctgaaggaaacatcctttaa tcaggcctatggtcgagatttaatggaggcccaagagtggtgcaggaagtacatgaaatc agggaatgtcaaggacctcacccaagcctgggacctctattatcatgtgttccgacgaatc agtggtggttcaggtggtgttagcgttagcggctggcgcctgttcaagaagatcagctaa |
| 107 | His6-FRB-10GS-289 (ATG3764) | MKHHHHHHVAILWHEMWHEGLEEASRLYFGERNVKG MFEVLEPLHAMMERGPQTLKETSFNQAYGRDLMEAQE WCRKYMKSGNVKDLTQAWDLYYHVFRRISGGSGGGGS GGVSVSGWRLFKKIS |
| 108 | His6-FRB-10GS-289 (ATG3764) | atgaaacatcaccatcaccatcatgtggccatcctctggcatgagatgtggcatgaaggcc tggaagaggcatctcgtttgtactttggggaaaggaacgtgaaaggcatgtttgaggtgct ggagcccttgcatgctatgatggaacggggccccagactctgaaggaaacatcctttaa tcaggcctatggtcgagatttaatggaggcccaagagtggtgcaggaagtacatgaaatc agggaatgtcaaggacctcacccaagcctgggacctctattatcatgtgttccgacgaatc agtggtggttcaggtggtggcgggagcggtggcgttagcgttagcggctggcgcctgtt caagaagatcagctaa |
| 109 | His6-FRB-15GS-289 (ATG3765) | MKHHHHHHVAILWHEMWHEGLEEASRLYFGERNVKG MFEVLEPLHAMMERGPQTLKETSFNQAYGRDLMEAQE WCRKYMKSGNVKDLTQAWDLYYHVFRRISGGSGGGGS GGSSSGGVSVSGWRLFKKIS |
| 110 | His6-FRB-15GS-289 (ATG3765) | atgaaacatcaccatcaccatcatgtggccatcctctggcatgagatgtggcatgaaggcc tggaagaggcatctcgtttgtactttggggaaaggaacgtgaaaggcatgtttgaggtgct ggagcccttgcatgctatgatggaacggggccccagactctgaaggaaacatcctttaa tcaggcctatggtcgagatttaatggaggcccaagagtggtgcaggaagtacatgaaatc agggaatgtcaaggacctcacccaagcctgggacctctattatcatgtgttccgacgaatc agtggtggttcaggtggtggcgggagcggtggctcgagcagcggtggagttagcgttag cggctggcgcctgttcaagaagatcagctaa |
| 111 | SmTrip9-FKBP fusion template (ATG780) | M- GSMLFRVTINS - SSSGGGSGGGSSGGGVQVETISPGDGRTFPKRGQTCVV HYTG MLEDGKKFDSSRDRNKPFKFMLGKQEVIRGWEEGVAQ MSVGQRAKLTISPDYAYGATGHPGIIPPHATLVFDVELL KLE |
| 112 | SmTrip9-FKBP fusion template (ATG780) | atgggctccatgctgttccgagtaaccatcaacagctcgagttcaggtggtggcgggagc ggtggagggagcagcggtggaggagtgcaggtggaaaccatctcccccaggagacgg gcgcaccttccccaagcgcggccagacctgcgtggtgcactacaccgggatgcttgagg atggaaagaaatttgattcctcccgggacagaaacaagcccttttaagtttatgctaggcaa gcaggaggtgatccgaggctgggaagaaggggttgcccagatgagtgtgggtcagag agccaaactgactatatctccagattatgcctatggtgccactgggcacccaggcatcatc ccaccacatgccactctcgtcttcgatgtggagcttctaaaactggaataa |
| 113 | FKBP-SmTrip9 fusion template (ATG777) | MGVQVETISPGDGRTFPKRGQTCVVHYTGMLEDGKKFD SSRDRNKPFKFMLGKQEVIRGWEEGVAQMSVGQRAKLT ISPDYAYGATGHPGIIPPHATLVFDVELLKLEGGSGGGGS GGSSSGGAI- GSMLFRVTINS |
| 114 | FKBP-SmTrip9 fusion template (ATG777) | Atgggagtgcaggtggaaaccatctcccccaggagacgggcgcaccttccccaagcgc ggccagacctgcgtggtgcactacaccgggatgcttgaagatggaaagaaatttgattcc tcccgggacagaaacaagcccttttaagtttatgctaggcaagcaggaggtgatccgagg ctgggaagaaggggttgcccagatgagtgtgggtcagagagccaaactgactatatctc cagattatgcctatggtgccactgggcacccaggcatcatcccaccacatgccactctcgt cttcgatgtggagcttctaaaactggaaggtggttcaggtggtggcgggagcggtggctc gagcagcggtggagcgatcggtccatgctgttccgagtaaccatcaacagc |
| 115 | LgBiT (ATG2623) | MVFTLEDFVGDWEQTAAYNLDQVLEQGGVSSLLQNLA VSVTPIQRIVRSGENALKIDIHVIIPYEGLSADQMAQIEEV FKVVYPVDDHHFKVILPYGTLVIDGVTPNMLNYFGRPYE GIAVFDGKKITVTGTLWNGNKIIDERLITPDGSMLFRVTI NSHHHHHH |
| 116 | LgBiT (ATG2623) | atggtcttcacactcgaagatttcgttggggactgggaacagacagccgcctacaacctg gaccaagtccttgaacaggaggtgtgtccagtttgctgcagaatctcgccgtgtccgtaa ctccgatccaaaggattgtccggagcggtgaaaatgccctgaagatcgacatccatgtca tcatcccgtatgaaggtctgagcgccgaccaaatggcccagatcgaagaggtgtttaagg tggtgtaccctgtggatgatcatcactttaaggtgatcctgccctatggcacactggtaatcg acggggttacgccgaacatgctgaactatttcggacggccgtatgaaggcatcgccgtgt |

TABLE 1-continued

Exemplary peptide, dipeptide, and polypeptide sequences.

| SEQ ID NO | Name | Sequence |
|---|---|---|
| | | tcgacggcaaaaagatcactgtaacagggaccctgtggaacggcaacaaaattatcgac gagcgcctgatcaccccgacggctccatgctgttccgagtaaccatcaacagccatcat caccatcaccactaa |
| 133 | pep78 | NVSGWRLFKKISN |
| 134 | pep79 | NVTGYRLFKKISN |
| 135 | pep80 | VSGWRLFKKISN |
| 136 | pep81 | SGWRLFKKISN |
| 137 | pep82 | GWRLFKKISN |
| 138 | pep99 | VTGYRLFEKIS |
| 139 | pep219 | SGWRLFKKIS |
| 140 | pep225 | VSGWRL |
| 141 | pep226 | VSGWRLF |
| 142 | pep227 | VSGWRLFK |
| 143 | pep228 | VSGWRLFKK |
| 144 | pep229 | VSGWRLFKKI |
| 145 | pep243 | VSGWRLYKKIS |
| 146 | pep272 | GSMLFRVTINSVSGWALFKKIS |
| 147 | pep274 | GSMLFRVTINSVTGYRLFEEIL |
| 148 | pep287 (WT SmTrip9)+Cterm solubility tag | GSMLFRVTINSSSWKR |
| 149 | pep288 | VSGVSGWRLFKKIS |
| 150 | pep289 | VSVSGWRLFKKIS |
| 151 | pep290 | VVSGWRLFKKIS |
| 152 | pep291 | SSWKRSMLFRVTINS |
| 153 | pep292 | SSWKRMLFRVTINS |
| 154 | pep293 | SSWKRDGSMLFRVTINS |
| 155 | pep294 | SSWKRPDGSMLFRVTINS |
| 156 | pep296 | SSWKRSMLFRVTINSV |
| 157 | pep297 | SSWKRMLFRVTINSV |
| 158 | pep298 | SSWKRDGSMLFRVTINSV |
| 159 | pep299 | SSWKRPDGSMLFRVTINSV |
| 160 | pep301 | SSWKRSMLFRVTINSVS |
| 161 | pep302 | SSWKRMLFRVTINSVS |
| 162 | pep303 | SSWKRDGSMLFRVTINSVS |
| 163 | pep304 | SSWKRPDGSMLFRVTINSVS |
| 164 | pep305 | SSWKRGSMLFRVTIN |
| 165 | pep306 | SSWKRGSMLFRVTI |
| 166 | pep307 | SSWKRSMLFRVTIN |

TABLE 1-continued

Exemplary peptide, dipeptide, and polypeptide sequences.

| SEQ ID NO | Name | Sequence |
|---|---|---|
| 167 | pep308 | SSWKRMLFRVTIN |
| 168 | pep309 | SSWKRDGSMLFRVTIN |
| 169 | pep310 | SSWKRPDGSMLFRVTIN |
| 170 | pep311 | SSWKRSMLFRVTI |
| 171 | pep312 | SSWKRMLFRVTI |
| 172 | pep313 | SSWKRDGSMLFRVTI |
| 173 | pep314 | SSWKRPDGSMLFRVTI |
| 174 | pep316 | VSGWRLFKKISVFTL |
| 175 | pep317 | VSGWRLFKKISVFT |
| 176 | pep318 | VSGWRLFKKISVF |
| 177 | pep319 | VSGWRLFKKISV |
| 178 | pep320 | VSGWRLCKKIS |
| 179 | pep326 | VSGWRLFKKISGSMLFRVTINS |
| 180 | pep380 | SSWKRLFRVTINS |
| 181 | pep383 | SSWKRFRVTINS |
| 182 | pep386 | SSWKRRVTINS |
| 183 | pep389 | SSWKRTPDGSMLFRVTINS |
| 184 | pep392 | SSWKRITPDGSMLFRVTINS |
| 185 | pep395 | SSWKRLITPDGSMLFRVTINS |
| 186 | pep396 | SSRGSMLFRVTINSWK |
| 187 | pep397 | SKRGSMLFRVTINSWS |
| 188 | pep398 | SWRGSMLFRVTINS |
| 189 | pep400 | SSRGSMLFRVTIWK |
| 190 | pep401 | SSWKRGSMLYRVTINS |
| 191 | pep402 | SSWKRGSMLWRVTINS |
| 192 | pep403 | SSWKRGSMLHRVTINS |
| 193 | pep404 | SSWKRGSLLFRVTINS |
| 194 | pep405 | SSWKRGSKLFRVTINS |
| 195 | pep406 | SSWKRGSRLFRVTINS |
| 196 | pep407 | SSWKRGSFLFRVTINS |
| 197 | pep408 | SSWKRGSWLFRVTINS |
| 198 | pep409 | SSWKRGSMLFRVSINS |
| 199 | pep410 | SSWKRGSMLFRVQINS |
| 200 | pep411 | SSWKRGSMLFRVNINS |
| 201 | SmTrip9-286 with cysteine | SSWKRGSMLFRVTINSC |
| 202 | HiBit with cysteine | CVSGWRLFKKIS |

TABLE 1-continued

Exemplary peptide, dipeptide, and polypeptide sequences.

| SEQ ID NO | Name | Sequence |
|---|---|---|
| 203 | SmTrip9-286 with azide | SSWKRGSMLFRVTINSK(Aza) |
| 204 | HiBit with azide | (aza)KVSGWRLFKKIS |
| 205 | WT OgLuc dipeptide | GSLLFRVTINGVTGWRLCENILA |
| 206 | WT NanoLuc® dipeptide | GSLLFRVTINVGVTGWRLCERILA |
| 207 | pep 157 | SVSGWRLFKKIS |
| 208 | pep 158 | NSVSGWRLFKKIS |
| 209 | pep206 | GWRLFKKIS |
| 210 | HIBIT-His-LgTrip3546 (ATG 3745) | Atggtgagcggctggcggctgttcaagaagattagccaccatcaccatcaccatcatcac ttcacactcgacgatttcgttggggactgggaacagacagccgcctacaacctggaccaa gtccttgaacagggaggtgtgtccagtttgctgcagaatctcgccgtgtccgtaactccgat catgaggattgtccggagcggtgaaaatgccctgaagatcgacatccatgtcatcatccc gtatgaaggtctgagcgccgaccaaatggcccagatcgaagaggtgtttaaggtggtgta ccctgtggatgatcatcactttaaggtgatcctgccctatggcacactggtaatcgacggg gttacgccgaacaagctgaactattcggacggccgtatgaaggcatcgccgtgttcgac ggcaaaaagatcactaccacagggaccctgtggaacggcaacaaaattatcgacgagc gcctgatcacccccgactaa |
| 211 | HIBIT-His-LgTrip3546 (ATG 3745) | MVSGWRLFKKISHHHHHHHFTLDDFVGDWEQTAAYN LDQVLEQGGVSSLLQNLAVSVTPIMRIVRSGENALKIDIH VIIPYEGLSADQMAQIEEVFKVVYPVDDHHFKVILPYGTL VIDGVTPNKLNYFGRPYEGIAVFDGKKITTTGTLWNGNK IIDERLITPD |
| 212 | His-HIBIT-GSSG-LgTrip3546 (ATG 3746) | Atgaaacatcaccatcaccatcatgtgagcggctggcggctgttcaagaagattagcgg cagctccggtttcacactcgacgatttcgttggggactgggaacagacagccgcctacaa cctggaccaagtccttgaacagggaggtgtgtccagtttgctgcagaatctcgccgtgtcc gtaactccgatcatgaggattgtccggagcggtgaaaatgccctgaagatcgacatccat gtcatcatcccgtatgaaggtctgagcgccgaccaaatggcccagatcgaagaggtgttt aaggtggtgtaccctgtggatgatcatcactttaaggtgatcctgccctatggcacactggt aatcgacggggttacgccgaacaagctgaactattcggacggccgtatgaaggcatcg ccgtgttcgacggcaaaaagatcactaccacagggaccctgtggaacggcaacaaaatt atcgacgagcgcctgatcacccccgactaa |
| 213 | His-HiBIT-GSSG-LgTrip3546 (ATG 3746) | MKHHHHHHVSGWRLFKKISGSSGFTLDDFVGDWEQTA AYNLDQVLEQGGVSSLLQNLAVSVTPIMRIVRSGENALK IDIHVIIPYEGLSADQMAQIEEVFKVVYPVDDHHFKVILP YGTLVIDGVTPNKLNYFGRPYEGIAVFDGKKITTTGTLW NGNKIIDERLITPD |
| 214 | FRB-15GS-86, no AI in linker (ATG3768) | Atggtggccatcctctggcatgagatgtggcatgaaggcctggaagaggcatctcgtttg tactttggggaaaggaacgtgaaaggcatgtttgaggtgctggagcccttgcatgctatga tggaacggggccccagactctgaaggaaacatcctttaatcaggcctatggtcgagattt aatggagcccaagagtggtgcaggaagtacatgaaatcagggaatgtcaaggacctc acccaagcctgggacctctattatcatgtgttccgacgaatcagtggtggttcaggtggtg gcgggagcggtggctcgagcagcggtggagtgagcggctggcggctgttcaagaaga ttagctaa |
| 215 | FRB-15GS-86, no AI in linker (ATG3768) | MVAILWHEMWHEGLEEASRLYFGERNVKGMFEVLEPL HAMMERGPQTLKETSFNQAYGRDLMEAQEWCRKYMK SGNVKDLTQAWDLYYHVFRRISGGSGGGGSGGSSGGV SGWRLFKKIS |
| 216 | FRB-15GS-289 (ATG3769) | Atggtggccatcctctggcatgagatgtggcatgaaggcctggaagaggcatctcgtttg tactttggggaaaggaacgtgaaaggcatgtttgaggtgctggagcccttgcatgctatga tggaacggggccccagactctgaaggaaacatcctttaatcaggcctatggtcgagattt aatggagcccaagagtggtgcaggaagtacatgaaatcagggaatgtcaaggacctc acccaagcctgggacctctattatcatgtgttccgacgaatcagtggtggttcaggtggtg gcgggagcggtggctcgagcagcggtggagttagcgttagcggctggcgcctgttcaa gaagatcagctaa |

TABLE 1-continued

Exemplary peptide, dipeptide, and polypeptide sequences.

| SEQ ID NO | Name | Sequence |
|---|---|---|
| 217 | FRB-15GS-289 (ATG3769) | MVAILWHEMWHEGLEEASRLYFGERNVKGMFEVLEPL HAMMERGPQTLKETSFNQAYGRDLMEAQEWCRKYMK SGNVKDLTQAWDLYYHVFRRISGGSGGGGSGGSSSGGV SVSGWRLFKKIS |
| 218 | FKBP-SmTrip9 fusion template, no AI in linker (ATG3770) | atgggagtgcaggtggaaaccatctccccaggagacgggcgcaccttccccaagcgcg gccagacctgcgtggtgcactacaccgggatgcttgaagatggaaagaaatttgattcctc ccgggacagaaacaagccctttaagtttatgctaggcaagcaggaggtgatccgaggct gggaagaaggggttgcccagatgagtgtgggtcagagagccaaactgactatatctcca gattatgcctatggtgccactgggcacccaggcatcatcccaccacatgccactctcgtctt cgatgtggagcttctaaaactggaaggtggttcaggtggtggcgggagcggtggctcga gcagcggtgga |
| 219 | FKBP-SmTrip9 fusion template, no AI in linker (ATG3770) | MGVQVETISPGDGRTFPKRGQTCVVHYTGMLEDGKKFD SSRDRNKPFKFMLGKQEVIRGWEEGVAQMSVGQRAKLT ISPDYAYGATGHPGIIPPHATLVFDVELLKLEGGSGGGGS GGSSSGG |
| 220 | 295 | GSMLFRVTINSV |
| 221 | 300 | GSMLFRVTINSVS |
| 222 | 412 | MLFRVTINSVSG |
| 223 | 413 | MLFRVTINSVSGW |
| 224 | 415 | MLFRVTINSVSGWK |
| 225 | 416 | MLFRVTINSVSGWR |
| 226 | 418 | GSMLFRVTINSVSG |
| 227 | 419 | GSMLFRVTINSVSGW |
| 228 | 422 | GSMLFRVTINSVSGWR |
| 229 | 423 | GSMLFRVTINSVSGWK |
| 230 | 434 | GSMLFRVTIWK |
| 231 | 435 | GSMLFRVTINSWK |
| 232 | 477 | MLFRVTINSWK |
| 233 | 478 | MLFRVTINSWS |
| 234 | 479 | MLFRVTIWS |
| 235 | 480 | MLFRVTIWK |
| 236 | 48 | MLFRVKINS |
| 237 | 482 | GSMLFRVTINSWS |
| 238 | 483 | GSMLFRVKINS |
| 239 | 484 | GSMLFRVTIWS |
| 240 | 485 | MLFRVNINS |
| 241 | 486 | MLFRVWINS |
| 242 | 487 | LLFRVKINS |
| 243 | 488 | FLFRVTINS |
| 244 | 295 | SSWKRGSMLFRVTINSV |
| 245 | 300 | SSWKRGSMLFRVTINSVS |
| 246 | 412 | SSWKRMLFRVTINSVSG |

TABLE 1-continued

Exemplary peptide, dipeptide, and polypeptide sequences.

| SEQ ID NO | Name | Sequence |
|---|---|---|
| 247 | 413 | SSWKRMLFRVTINSVSGW |
| 248 | 414 | SSWKRMLFRVTINSVSGWR |
| 249 | 415 | SSWKRMLFRVTINSVSGWK |
| 250 | 417 | MLFRVTINSVSGWK |
| 251 | 418 | SSWKRGSMLFRVTINSVSG |
| 252 | 419 | SSWKRGSMLFRVTINSVSGW |
| 253 | 420 | SSWKRGSMLFRVTINSVSGWR |
| 254 | 421 | SSWKRGSMLFRVTINSVSGWK |
| 255 | 424 | SSWKRGSYLFRVTINS |
| 256 | 425 | SSWKRGSMLFRVKINS |
| 257 | 426 | SSWKRGSMLFRVRINS |
| 258 | 427 | SSWKRGSMLFRVWINS |
| 259 | 428 | SSKRGSMLFRVTIWSV |
| 260 | 429 | SSKRGSMLFRVTIWSVS |
| 261 | 430 | SSWRGSMLFRVTIKS |
| 262 | 431 | KRSSGSMLFRVTIWS |
| 263 | 432 | SSKRMLFRVTIWS |
| 264 | 433 | KRSSMLFRVTIWS |
| 265 | 445 | GSMKFRVTINSWK |
| 266 | 450 | GSMLFRKTINSWK |
| 267 | 455 | GSMLFRVTKNSWK |
| 268 | 521 | GKMLFRVTINSWK |
| 269 | 522 | GKMLFRVTIWK |
| 270 | 523 | GSMKFRVTINSWK |
| 271 | 524 | GSMKFRVTIWK |
| 272 | 525 | GRMLFRVTINSWK |
| 273 | 526 | GRMLFRVTIWK |
| 274 | 527 | GSMRFRVTINSWK |
| 275 | 528 | GSMRFRVTIWK |
| 276 | 529 | GDMLFRVTINSWK |
| 277 | 530 | GDMLFRVTIWK |
| 278 | 53 | GSMDFRVTINSWK |
| 279 | 532 | GSMDFRVTIWK |
| 280 | 533 | GEMLFRVTINSWK |
| 281 | 535 | GSMEFRVTINSWK |
| 282 | 536 | GSMEFRVTIWK |
| 283 | 538 | GSMLFRVTIWKVK |

TABLE 1-continued

Exemplary peptide, dipeptide, and polypeptide sequences.

| SEQ ID NO | Name | Sequence |
|---|---|---|
| 284 | 539 | GSMLFRVTIWSVK |
| 285 | 540 | GSMLFRVTIWSK |
| 286 | 541 | GSMLFRVTIWKWK |
| 287 | 542 | GSMLFRVTIWKK |
| 288 | 245 | GSMLFRVTINS |
| 289 | 292.x | MLFRVTINS |
| 290 | 297.x | MLFVTINSV |
| 291 | 302.x | MLFRVTINSVS |
| 292 | 305.x | GSMLFRVTIN |
| 293 | 306.x | GSMLFRVTI |
| 294 | 307.x | SMLFRVTIN |
| 295 | 308.x | MLFRVTIN |
| 296 | 312.x | MLFRVTI |
| 297 | 399 | SSKRGSMLFRVTIWS |
| 298 | 273 | GSMLFRVTINSGVSGWALFKKIS |
| 299 | 264 | GSMLFRVTINSGVSGWRLFKKIS |
| 300 | 167 | VSGWALFKKIS |
| 301 | 331 | GSMLFRVTINSVSGVSGWRLFKKIS |
| 302 | LgTrip 3546 (no His6) | MVFTLDDFVGDWEQTAAYNLDQVLEQGGVSSLLQNLA VSVTPIMRIVRSGENALKIDIHVIIPYEGLSADQMAQIEEV FKVVYPVDDHHFKVILPYGTLVIDGVTPNKLNYFGRPYE GIAVFDGKKITTTGTLWNGNKIIDERLITPD |
| 303 | LgTrip 3546 (no His6) | atggtcttcacactcgacgatttcgttggggactgggaacagacagccgcctacaacctg gaccaagtccttgaacaggaggtgtgtccagtttgctgcagaatctcgccgtgtccgtaa ctccgatcatgaggattgtccggagcggtgaaaatgccctgaagatcgacatccatgtcat catcccgtatgaaggtctgagcgccgaccaaatggcccagatcgaagaggtgtttaaggt ggtgtaccctgtggatgatcatcactttaaggtgatcctgccctatggcacactggtaatcg acggggttacgccgaacaagctgaactatttcggacggccgtatgaaggcatcgccgtgt tcgacggcaaaaagatcactaccacagggaccctgtggaacggcaacaaaattatcgac gagcgcctgatcaccccgac |
| 304 | LgTrip 2098 (no His6) | MVFTLDDFVGDWEQTAAYNLDQVLEQGGVSSLLQNLA VSVTPIMRIVRSGENALKIDIHVIIPYEGLSADQMAQIEEV FKVVYPVDDHHFKVILPYGTLVIDGVTPNKLNYFGRPYE GIAVFDGKKITVTGTLWNGNKIIDERLITPD |
| 305 | LgTrip 2098 (no His6) | atggtcttcacactcgaagatttcgttggggactgggaacagacagccgcctacaacctg gaccaagtccttgaacaggaggtgtgtccagtttgctgcagaatctcgccgtgtccgtaa ctccgatccaaaggattgtccggagcggtgaaaatgccctgaagatcgacatccatgtca tcatcccgtatgaaggtctgagcgccgaccaaatggcccagatcgaagaggtgtttaagg tggtgtaccctgtggatgatcatcactttaaggtgatcctgccctatggcacactggtaatcg acggggttacgccgaacatgctgaactatttcggacggccgtatgaaggcatcgccgtgt tcgacggcaaaaagatcactgtaacagggaccctgtggaacggcaacaaaattatcgac gagcgcctgatcaccccgac |
| 306 | 157 | SVSGWRLFKKIS |
| 307 | 158 | NSVSGWRLFKKIS |
| 308 | 206 | GWRLFKKIS |
| 309 | 264 | GSMLFRVTINSGVSGWRLFKKIS |
| 310 | 489 | GSMLFRVTINSWK (N-term unblocked) |

TABLE 1-continued

Exemplary peptide, dipeptide, and polypeptide sequences.

| SEQ ID NO | Name | Sequence |
|---|---|---|
| 311 | 490 | GSMLFRVTINSWK (C-term unblocked) |
| 312 | 491 | GSMLFRVTINSWK (Both unblocked) |
| 313 | 492 | GSMLFRVTINKWK |
| 314 | 493 | GSMLFRVTIKSWK |
| 315 | 494 | GSMLFRVTINRWK |
| 316 | 495 | GSMLFRVTIRSWK |
| 317 | 496 | GSMLFRVTINDWK |
| 318 | 497 | GSMLFRVTIDSWK |
| 319 | 498 | GSMLFRVTINEWK |
| 320 | 499 | GSMLFRVTIESWK |
| 321 | 465 | GSMRFRVTINSWK (Both termini unblocked) |
| 322 | 466 | GSMDFRVTINSWK (Both termini unblocked) |
| 323 | 467 | GSMEFRVTINSWK (Both termini unblocked) |
| 324 | 468 | GSMLFRRTINSWK (Both termini unblocked) |
| 325 | 469 | GSMLFRDTINSWK (Both termini unblocked) |
| 326 | 470 | GSMLFRETINSWK (Both termini unblocked) |
| 327 | 472 | GSMLFRVTDNSWK (Both termini unblocked) |
| 328 | 473 | GSMLFRVTENSWK (Both termini unblocked) |
| 329 | 474 | GSMKFRVTINSWK (Both termini unblocked) |
| 330 | 475 | GSMLFRKTINSWK (Both termini unblocked) |
| 331 | 476 | GSMLFRVTKNSWK (Both termini unblocked) |
| 332 | 436 | GSMLFRVTINS (N-term unblocked) |
| 333 | 437 | GSMLFRVSINS (N-term unblocked) |
| 334 | 438 | GSMLFRVNINS (N-term unblocked) |
| 335 | 439 | GSKLFRVTINS (N-term unblocked) |
| 336 | 440 | GSRLFRVTINS (N-term unblocked) |
| 337 | 441 | GSMWFRVTINS (N-term unblocked) |
| 338 | 442 | GSMSFRVTINS (N-term unblocked) |
| 339 | 443 | GSMNERVTINS (N-term unblocked) |
| 340 | 444 | GSMKFRVTINS (N-term unblocked) |
| 341 | 446 | GSMLFRWTINS (N-term unblocked) |
| 342 | 447 | GSMLFRSTINS (N-term unblocked) |
| 343 | 448 | GSMLFRNTINS (N-term unblocked) |
| 344 | 449 | GSMLFRKTINS (N-term unblocked) |
| 345 | 451 | GSMLFRVTWNS (N-term unblocked) |
| 346 | 452 | GSMLFRVTSNS (N-term unblocked) |
| 347 | 453 | GSMLFRVTNNS (N-term unblocked) |

TABLE 1-continued

Exemplary peptide, dipeptide, and polypeptide sequences.

| SEQ ID NO | Name | Sequence |
|---|---|---|
| 348 | 454 | GSMLFRVTKNS (N-term unblocked) |
| 349 | 456 | GSMLFRVTIKS (N-term unblocked) |
| 350 | Antares ATG 3802 | MKHHHHHHVSKGEELIKENMRSKLYLEGSVNGHQFKCT HEGEGKPYEGKQTNRIKVVEGGPLPFAFDILATHFMYGS KVFIKYPADLPDYFKQSFPEGFTWERVMVFEDGGVLTAT QDTSLQDGELIYNVKVRGVNFPANGPVMQKKTLGWEPS TETMYPADGGLEGRCDKALKLVGGGHLHVNFKTTYKS KKPVKMPGVHYVDRRLERIKEADNETYVEQYEHAVAR YSNLGGGFTLEDFVGDWRQTAGYNLDQVLEQGGVSSLF QNLGVSVTPIQRIVLSGENGLKIDIHVIIPYEGLSGDQMG QIEKIFKVVYPVDDHHFKVILHYGTLVIDGVTPNMIDYFG RPYEGIAVFDGKKITVTGTLWNGNKIIDERLINPDGSLLF RVTINGVTGWRLCERILARHELIKENMRSKLYLEGSVNG HQFKCTHEGEGKPYEGKQTNRIKVVEGGPLPFAFDILAT HFMYGSKVFIKYPADLPDYFKQSFPEGFTWERVMVFED GGVLTATQDTSLQDGELIYNVKVRGVNFPANGPVMQKK TLGWEPSTETMYPADGGLEGRCDKALKLVGGGHLHVN FKTTYKSKKPVKMPGVHYVDRRLERIKEADNETYVEQY EHAVARYSNLGGGMDELYK |
| 351 | Antares ATG 3802 | atgaaacatcaccatcaccatcatgtgagcaaggagaagaacttataaaagaaaacatg cggtctaaactgtacctcgagggctccgtcaatgggcaccagtttaagtgtacccacgag ggtgagggaaagccctatgaggggaagcagacaaaccgcatcaaggtcgtcgaaggg ggacccctcccgtttgcctttgatatcttggctactcactttatgtacggaagcaaagtttcat aaagtatcctgccgaccttcctgattattttaaacagtcatttcccgagggtttcacatggga aaggtcatggtgtttgaggatggaggcgtgctcactgcaactcaggacacctcactgca ggacggcgagctgatctacaatgtgaaggtccggggtgtaaacttccctgccaacgggc ctgtaatgcagaagaagacctgggatgggagccgtccaccgaaaccatgtaccctgct gatggtgggctggagggccgatgtgacaaggctctgaagctcgttggaggtggtcatttg cacgtaaatttcaagacaacttacaagagcaaaaaacccgtaaaaatgcccgggttcatt acgttgacagaaggcttgaacgcataaaaggaagctgataacgagacatacgtggagcag tacgagcacgccgttgcccggtactcaaacctggggggggctttacactggaggattttg tgggagattggagacagacagccggctacaatctggatcaggtgctggaacaaggagg agtgtcttctctgtttcagaatctgggagtgagcgtgacacctatccagaggatcgtgctgt ctggcgagaatggactgaagatcgatattcacgtgatcatccctacgaaggcctgtctgg agaccagatgggccagattgagaagatcttcaaagtggtgtatcctgtggacgatcacca cttcaaggtgatcctgcactacggcaccctggtgattgatggagtgacacctaacatgatc gactacttcggaagacccttacgagggaatcgccgtgttcgacggaaagaagatcaccgt gacaggaacactgtggaatggaaacaagatcatcgacgagcggctgatcaaccctgatg gatctctgctgttcagagtgaccatcaacggagtgacaggatggagactgtgcgagaga attctggctagacatgagctaatcaaggaaaatgagaagtaagctatacttagagggggt ccgtcaacggtcaccagtttaaatgcactcatgaaggtgagggggaaaccttatgaaggta agcagactaatcgaataaaagtggtcgagggcggtcctctgccattcgctttcgatattctg gccactcactttatgtatgggtctaaggtctttattaaataccccgctgatttgccagactactt taaacagtccttccctgaaggattcacatgggagcgggtgatggtgttcgaggatggagg cgttcttactgcaactcaggatacttccttgcaagacggggaactgatctacaacgttaagg tccgcggcgtcaatttcccagccaatggtccagtgatgcagaagaaaccttgggtgggg agccctcaacggagacaatgtaccctgcgacggcgggcttgagggtagatgtgataag gcattgaaactcgtcggggcggccaccttcatgtgaatttcaagactacatataaaagta aaaaaccagtcaagatgcctggagtgcactacgtggatcgtaggttggagaggataaaa gaagccgacaacgaaacttatgtagagcaatatgagcacgccgtggctcgttattccaact tgggcggaggaatggatgaactgtacaag |
| 352 | Antares (LgBiT) ATG 3803 | MKHHHHHHVSKGEELIKENMRSKLYLEGSVNGHQFKCT HEGEGKPYEGKQTNRIKVVEGGPLPFAFDILATHFMYGS KVFIKYPADLPDYFKQSFPEGFTWERVMVFEDGGVLTAT QDTSLQDGELIYNVKVRGVNFPANGPVMQKKTLGWEPS TETMYPADGGLEGRCDKALKLVGGGHLHVNFKTTYKS KKPVKMPGVHYVDRRLERIKEADNETYVEQYEHAVAR YSNLGGGFTLEDFVGDWEQTAAYNLDQVLEQGGVSSLL QNLAVSVTPIQRIVRSGENALKIDIHVIIPYEGLSADQMA QIEEVFKVVYPVDDHHFKVILPYGTLVIDGVTPNMLNYF GRPYEGIAVFDGKKITVTGTLWNGNKIIDERLITPDGSML FRVTINSRHELIKENMRSKLYLEGSVNGHQFKCTHEGEG KPYEGKQTNRIKVVEGGPLPFAFDILATHFMYGSKVFIK YPADLPDYFKQSFPEGFTWERVMVFEDGGVLTATQDTS LQDGELIYNVKVRGVNFPANGPVMQKKTLGWEPSTETM YPADGGLEGRCDKALKLVGGGHLHVNFKTTYKSKKPV KMPGVHYVDRRLERIKEADNETYVEQYEHAVARYSNL GGGMDELYK |

TABLE 1-continued

Exemplary peptide, dipeptide, and polypeptide sequences.

| SEQ ID NO | Name | Sequence |
|---|---|---|
| 353 | Antares (LgBiT) ATG 3803 | atgaaacatcaccatcaccatcatgtgagcaaggggagaagaacttataaaagaaaacatg cggtctaaactgtacctcgagggctccgtcaatgggcaccagtttaagtgtacccacgag ggtgagggaaagcccctatgaggggaagcagacaaaccgcatcaaggtcgtcgaaggg ggaccctcccgtttgcctttgatatcttggctactcactttatgtacgaagcaaagttttcat aaagtatcctgccgaccttcctgattattttaaacagtcatttcccgagggtttcacatggga aagggtcatggtgtttgaggatggaggcgtgctcactgcaactcaggacacctcactgca ggacggcgagctgatctacaatgtgaaggtccggggtgtaaacttccctgccaacgggc ctgtaatgcagaagaagaccctgggatgggagccgtccaccgaaccatgtaccctgct gatggtgggctggagggccgatgtgacaaggctctgaagctcgttggaggtggtcatttg cacgtaaatttcaagacaacttacaagagcaaaaaacccgtaaaaatgcccggggttcatt acgttgacagaaggcttgaacgcataaaggaagctgataacgagacatacgtggagcag tacgagcacgccgttgcccggtactcaaacctggggggggcttcacactcgaagatttc gttggggactgggaacagacagccgcctacaacctggaccaagtccttgaacagggag gtgtgtccagtttgctgcagaatctcgccgtgtccgtaactccgatccaaaggattgtccgg agcggtgaaaatgccctgaagatcgacatccatgtcatcatcccgtatgaaggtctgagc gccgaccaaatggcccagatcgaagaggtgtttaaggtggtgtaccctgtggatgatcat cactttaaggtgatcctgccctatggcacactggtaatcgacggggttacgccgaacatgc tgaactatttcggacggccgtatgaaggcatcgccgtgttcgacggcaaaaagatcactgt aacagggaccctgtggaacggcaacaaaattatcgacgagcgcctgatcaccccgac ggctccatgctgttccgagtaaccatcaacagcagacatgagctaatcaaggaaaatatg agaagtaagctatacttagaggggtccgtcaacggtcaccagtttaaatgcactcatgaag gtgaggggaaacctatgaaggtaagcagactaatcgaataaaagtggtcgagggcggt cctctgccattcgctttcgatattctggccactcactttatgtatgggtctaaggtcttt- attaaa taccccgctgatttgccagactactttaaacagtccttccctgaaggattcacatgggagcg ggtgatggtgttcgaggatggaggcgttcttactgcaactcaggatacttccttgcaagac ggggaactgatctacaacgttaaggtccgcggcgtcaatttcccagccaatggtccagtg atgcagaagaaaccttgggggggagccctcaacggagacaatgtaccctgcggacg gcgggcttgagggtagatgtgataaggcattgaaactcgtcggggcggccaccttcat gtgaatttcaagactacatataaaagtaaaaaaccagtccaagtgcctggagtgcactacg tggatcgtaggttggaggggataaaagaagccgacaacgaaacttatgtagagcaatatg agcacgccgtggctcgttattccaacttgggcggaggaatggatgaactgtacaag |
| 354 | Antares (LgTrip 3546) ATG 3804 | MKHHHHHHVSKGEELIKENMRSKLYLEGSVNGHQFKCT HEGEGKPYEGKQTNRIKVVEGGPLPFAFDILATHFMYGS KVFIKYPADLPDYFKQSFPEGFTWERVMVFEDGGVLTAT QDTSLQDGELIYNVKVRGVNFPANGPVMQKKTLGWEPS TETMYPADGGLEGRCDKALKLVGGGHLHVNFKTTYKS KKPVKMPGVHYVDRRLERIKEADNETYVEQYEHAVAR YSNLGGGFTLDDFVGDWEQTAAYNLDQVLEQGGVSSLL QNLAVSVTPIMRIVRSGENALKIDIHVIIPYEGLSADQMA QIEEVFKVVYPVDDHHFKVILPYGTLVIDGVTPNKLNYF GRPYEGIAVFDGKKITTTGTLWNGNKIIDERLITPDRHELI KENMRSKLYLEGSVNGHQFKCTHEGEGKPYEGKQTNRI KVVEGGPLPFAFDILATHFMYGSKVFIKYPADLPDYFKQ SFPEGFTWERVMVFEDGGVLTATQDTSLQDGELIYNVK VRGVNFPANGPVMQKKTLGWEPSTETMYPADGGLEGR CDKALKLVGGGHLHVNFKTTYKSKKPVKMPGVHYVDR RLERIKEADNETYVEQYEHAVARYSNLGGGMDELYK |
| 355 | Antares (LgTrip 3546) ATG 3804 | atgaaacatcaccatcaccatcatgtgagcaaggggagaagaacttataaaagaaaacatg cggtctaaactgtacctcgagggctccgtcaatgggcaccagtttaagtgtacccacgag ggtgagggaaagcccctatgaggggaagcagacaaaccgcatcaaggtcgtcgaaggg ggaccctcccgtttgcctttgatatcttggctactcactttatgtacgaagcaaagttttcat aaagtatcctgccgaccttcctgattattttaaacagtcatttcccgagggtttcacatggga aagggtcatggtgtttgaggatggaggcgtgctcactgcaactcaggacacctcactgca ggacggcgagctgatctacaatgtgaaggtccggggtgtaaacttccctgccaacgggc ctgtaatgcagaagaagaccctgggatgggagccgtccaccgaaccatgtaccctgct gatggtgggctggagggccgatgtgacaaggctctgaagctcgttggaggtggtcatttg cacgtaaatttcaagacaacttacaagagcaaaaaacccgtaaaaatgcccggggttcatt acgttgacagaaggcttgaacgcataaaggaagctgataacgagacatacgtggagcag tacgagcacgccgttgcccggtactcaaacctggggggggcttcacactcgacgatttc gttggggactgggaacagacagccgcctacaacctggaccaagtccttgaacagggag gtgtgtccagtttgctgcagaatctcgccgtgtccgtaactccgatcatgaggattgtccgg agcggtgaaaatgccctgaagatcgacatccatgtcatcatcccgtatgaaggtctgagc gccgaccaaatggcccagatcgaagaggtgtttaaggtggtgtaccctgtggatgatcat cactttaaggtgatcctgccctatggcacactggtaatcgacggggttacgccgaacaag ctgaactatttcggacggccgtatgaaggcatcgccgtgttcgacggcaaaaagatcact accacagggaccctgtggaacggcaacaaaattatcgacgagcgcctgatcaccccg acagacatgagctaatcaaggaaaatatgagaagtaagctatacttagaggggtccgtca acggtcaccagtttaaatgcactcatgaaggtgaggggaaacctatgaaggtaagcaga ctaatcgaataaaagtggtcgagggcggtcctctgccattcgctttcgatattctggccact cactttatgtatgggtctaaggtctttattaaataccccgctgatttgccagactactttaaaca |

TABLE 1-continued

Exemplary peptide, dipeptide, and polypeptide sequences.

| SEQ ID NO | Name | Sequence |
|---|---|---|
| | | gtccttccctgaaggattcacatgggagcgggtgatggtgttcgaggatggaggcgttctt actgcaactcaggatacttccttgcaagacggggaactgatctacaacgttaaggtccgc ggcgtcaatttcccagccaatggtccagtgatgcagaagaaaaccttggggtgggagcc ctcaacggagacaatgtaccctgcggacgggggcttgagggtagatgtgataaggcat tgaaactcgtcgggggcggccaccttcatgtgaatttcaagactacatataaaagtaaaaa accagtcaagatgcctggagtgcactacgtggatcgtaggttggagaggataaaagaag ccgacaacgaaacttatgtagagcaatatgagcacgccgtggctcgttattccaacttggg cggaggaatggatgaactgtacaag |
| 356ATG | 3815 | MKHHHHHHFTLEDFVGDWEQTAAYNLDQVLEQGGVSS LLQNLAVSVTPIQRIVRSGENALKIDIHVIIPYEGLSADQM AQIEEVFKVVYPVDDHHFKVILPYGTLVIDGVTPNMLNY FGRPYEGIAVFDGKKITVTGTLWNGNKIIDERLITPDGSM LFRVTINSGGSGGSSGELIKENMRSKLYLEGSVNGHQFK CTHEGEGKPYEGKQTNRIKVVEGGPLPFAFDILATHFMY GSKVFIKYPADLPDYFKQSFPEGFTWERVMVFEDGGVLT ATQDTSLQDGELIYNVKVRGVNFPANGPVMQKKTLGW EPSTETMYPADGGLEGRCDKALKLVGGGHLHVNFKTTY KSKKPVKMPGVHYVDRRLERIKEADNETYVEQYEHAV ARYSNLGGGMDELYK |
| 357ATG | 3815 | atgaaacatcaccatcaccatcatttcacactcgaagatttcgttggggactgggaacaga cagccgcctacaacctggaccaagtccttgaacagggaggtgtgtccagtttgctgcaga atctcgccgtgtccgtaactccgatccaaaggattgtccggagcggtgaaaatgccctga agatcgacatccatgtcatcatcccgtatgaaggtctgagcgccgaccaaatggcccaga tcgaagaggtgtttaaggtggtgtaccctgtggatgatcatcactttaaggtgatcctgccct atggcacactggtaatcgacggggttacgccgaacatgctgaactatttcggacggccgt atgaaggcatcgccgtgttcgacggcaaaaagatcactgtaacagggaccctgtggaac ggcaacaaaattatcgacgagcgcctgatcaccccccgacggctccatgctgttccgagta accatcaacagcggaggctcaggtggatcctcaggtgagctaatcaaggaaaatatgag aagtaagctatacttagaggggtccgtcaacggtcaccagtttaaatgcactcatgaagt gaggggaaaccttatgaaggtaagcagactaatcgaataaaagtggtcgagggggtcc tctgccattcgctttcgatattctggccactcactttatgtatgggtctaaggtctttat- taaata ccccgctgatttgccagactactttaaacagtccttccctgaaggattcacatgggagcgg gtgatggtgttcgaggatggaggcgttcttactgcaactcaggatacttccttgcaagacg gggaactgatctacaacgttaaggtccgcggcgtcaatttcccagccaatggtccagtgat gcagaagaaaaccttggggggagccctcaacggagacaatgtaccctgcggacggc gggcttgagggtagatgtgataaggcattgaaactcgtcgggggcggccaccttcatgtg aatttcaagactacatataaaagtaaaaaccagtcaagatgcctggagtgcactacgtgg atcgtaggttggagaggataaaagaagccgacaacgaaacttatgtagagcaatatgag cacgccgtggctcgttattccaacttgggcggaggaatggatgaactgtacaag |
| 358ATG | 3816 | MKHHHHHHFTLEDFVGDWEQTAAYNLDQVLEQGGVSS LLQNLAVSVTPIQRIVRSGENALKIDIHVIIPYEGLSADQM AQIEEVFKVVYPVDDHHFKVILPYGTLVIDGVTPNMLNY FGRPYEGIAVFDGKKITVTGTLWNGNKIIDERLITPDGSM LFRVTINSRHELIKENMRSKLYLEGSVNGHQFKCTHEGE GKPYEGKQTNRIKVVEGGPLPFAFDILATHFMYGSKVFI KYPADLPDYFKQSFPEGFTWERVMVFEDGGVLTATQDT SLQDGELIYNVKVRGVNFPANGPVMQKKTLGWEPSTET MYPADGGLEGRCDKALKLVGGGHLHVNFKTTYKSKKP VKMPGVHYVDRRLERIKEADNETYVEQYEHAVARYSN LGGGMDELYK |
| 359ATG | 3816 | Atgaaacatcaccatcaccatcatttcacactcgaagatttcgttggggactgggaacaga cagccgcctacaacctggaccaagtccttgaacagggaggtgtgtccagtttgctgcaga atctcgccgtgtccgtaactccgatccaaaggattgtccggagcggtgaaaatgccctga agatcgacatccatgtcatcatcccgtatgaaggtctgagcgccgaccaaatggcccaga tcgaagaggtgtttaaggtggtgtaccctgtggatgatcatcactttaaggtgatcctgccct atggcacactggtaatcgacggggttacgccgaacatgctgaactatttcggacggccgt atgaaggcatcgccgtgttcgacggcaaaaagatcactgtaacagggaccctgtggaac ggcaacaaaattatcgacgagcgcctgatcaccccccgacggctccatgctgttccgagta accatcaacagcagacatgagctaatcaaggaaaatatgagaagtaagctatacttagag gggtccgtcaacggtcaccagtttaaatgcactcatgaaggtgaggggaaaccttatgaa ggtaagcagactaatcgaataaaagtggtcgagggcggtcctctgccattcgctttcgata ttctggccactcactttatgtatgggtctaaggtctttatataaatacccgctgatttgccagac tactttaaacagtccttccctgaaggattcacatgggagcgggtgatggtgttcgaggatg gaggcgttcttactgcaactcaggatacttccttgcaagacggggaactgatctacaacgtt aaggtccgcggcgtcaatttcccagccaatggtccagtgatgcagaagaaaaccttggg gtgggagccctcaacggagacaatgtaccctgcggacggcgggcttgagggtagatgt gataaggcattgaaactcgtcgggggcggccaccttcatgtgaatttcaagactacatata |

TABLE 1-continued

Exemplary peptide, dipeptide, and polypeptide sequences.

| SEQ ID NO | Name | Sequence |
|---|---|---|
| | | aaagtaaaaaaccagtcaagatgcctggagtgcactacgtggatcgtaggttggagagg<br>ataaaagaagccgacaacgaaacttatgtagagcaatatgagcacgccgtggctcgttatt<br>ccaacttgggcggaggaatggatgaactgtacaag |
| 360 | ATG 3817 | MKHHHHHHFTLDDFVGDWEQTAAYNLDQVLEQGGVSS<br>LLQNLAVSVTPIMRIVRSGENALKIDIHVIIPYEGLSADQ<br>MAQIEEVFKVVYPVDDHHFKVILPYGTLVIDGVTPNKLN<br>YFGRPYEGIAVFDGKKITTTGTLWNGNKIIDERLITPDGG<br>SGGSSGELIKENMRSKLYLEGSVNGHQFKCTHEGEGKPY<br>EGKQTNRIKVVEGGPLPFAFDILATHFMYGSKVFIKYPA<br>DLPDYFKQSFPEGFTWERVMVFEDGGVLTATQDTSLQD<br>GELIYNVKVRGVNFPANGPVMQKKTLGWEPSTETMYPA<br>DGGLEGRCDKALKLVGGGHLHVNFKTTYKSKKPVKMP<br>GVHYVDRRLERIKEADNETYVEQYEHAVARYSNLGGG<br>MDELYK |
| 361 | ATG 3817 | Atgaaacatcaccatcaccatcatttcacactcgacgatttcgttggggactgggaacaga<br>cagccgcctacaacctggaccaagtccttgaacagggaggtgtgtccagtttgctgcaga<br>atctcgccgtgtccgtaactccgatcatgaggattgtccggagcggtgaaaatgccctgaa<br>gatcgacatccatgtcatcatcccgtatgaaggtctgagcgccgaccaaatggcccagat<br>cgaagaggtgtttaaggtggtgtaccctgtggatgatcatcactttaaggtgatcctgccct<br>atggcacactggtaatcgacggggttacgccgaacaagctgaactatttcggacggccgt<br>atgaaggcatcgccgtgttcgacggcaaaaagatcactaccacagggaccctgtggaac<br>ggcaacaaaattatcgacgagcgcctgatcacccccgacggaggctcaggtggatcctc<br>aggtgagctaatcaaggaaaatatgagaagtaagctatacttagaggggtccgtcaacgg<br>tcaccagtttaaatgcactcatgaaggtgagggaaaccttatgaaggtaagcagactaat<br>cgaataaaagtggtcgaggcggtcctctgccattcgctttcgatattctggccactcacttt<br>atgtatgggtctaaggtctttattaaataccccgctgatttgccagactacttttaaacagtcctt<br>ccctgaaggattcacatgggagcgggtgatggtgttcgaggatggaggcgttcttactgc<br>aactcaggatacttccttgcaagacggggaactgatctacaacgttaaggtccgcggcgt<br>caatttcccagccaatggtccagtgatgcagaagaaaaccttggggtgggagccctcaac<br>ggagacaatgtaccctgcggacgcgggcttgagggtagatgtgataaggcattgaaac<br>tcgtcggggcggccaccttcatgtgaatttcaagactacatataaaagtaaaaaaccagt<br>caagatgcctggagtgcactacgtggatcgtaggttggagaggataaaagaagccgaca<br>acgaaacttatgtagagcaatatgagcacgccgtggctcgttattccaacttgggcggag<br>gaatggatgaactgtacaag |
| 362 | ATG 3818 | MKHHHHHHFTLDDFVGDWEQTAAYNLDQVLEQGGVSS<br>LLQNLAVSVTPIMRIVRSGENALKIDIHVIIPYEGLSADQ<br>MAQIEEVFKVVYPVDDHHFKVILPYGTLVIDGVTPNKLN<br>YFGRPYEGIAVFDGKKITTTGTLWNGNKIIDERLITPDRH<br>ELIKENMRSKLYLEGSVNGHQFKCTHEGEGKPYEGKQT<br>NRIKVVEGGPLPFAFDILATHFMYGSKVFIKYPADLPDYF<br>KQSFPEGFTWERVMVFEDGGVLTATQDTSLQDGELIYN<br>VKVRGVNFPANGPVMQKKTLGWEPSTETMYPADGGLE<br>GRCDKALKLVGGGHLHVNFKTTYKSKKPVKMPGVHYV<br>DRRLERIKEADNETYVEQYEHAVARYSNLGGGMDELYK |
| 363 | ATG 3818 | Atgaaacatcaccatcaccatcatttcacactcgacgatttcgttggggactgggaacaga<br>cagccgcctacaacctggaccaagtccttgaacagggaggtgtgtccagtttgctgcaga<br>atctcgccgtgtccgtaactccgatcatgaggattgtccggagcggtgaaaatgccctgaa<br>gatcgacatccatgtcatcatcccgtatgaaggtctgagcgccgaccaaatggcccagat<br>cgaagaggtgtttaaggtggtgtaccctgtggatgatcatcactttaaggtgatcctgccct<br>atggcacactggtaatcgacggggttacgccgaacaagctgaactatttcggacggccgt<br>atgaaggcatcgccgtgttcgacggcaaaaagatcactaccacagggaccctgtggaac<br>ggcaacaaaattatcgacgagcgcctgatcacccccgacagacatgagctaatcaagga<br>aaatatgagaagtaagctatacttagaggggtccgtcaacggtcaccagtttaaatgcact<br>catgaaggtgagggaaaccttatgaaggtaagcagactaatcgaataaaagtggtcga<br>gggcggtcctctgccattcgctttcgatattctggccactcactttatgtatgggtctaaggtc<br>tttattaaataccccgctgatttgccagactactttaaacagtccttccctgaaggattcacat<br>gggagcgggtgatggtgttcgaggatggaggcgttcttactgcaactcaggatacttcctt<br>gcaagacggggaactgatctacaacgttaaggtccgcggcgtcaatttcccagccaatg<br>gtccagtgatgcagaagaaaaccttgggggggagccctcaacggagacaatgtaccct<br>gcggacggcgggcttgagggtagatgtgataaggcattgaaactcgtcggggcggcc<br>accttcatgtgaatttcaagactacatataaaagtaaaaaaccagtcaagatgcctggagtg<br>cactacgtggatcgtaggttggagaggataaaagaagccgacaacgaaacttatgtaga<br>gcaatatgagcacgccgtggctcgttattccaacttgggcggaggaatggatgaactgta<br>caag |
| 364 | LgTrip 2899 (LgTrip 2098+Q42L) | MKHHHHHHVFTLEDFVGDWEQTAAYNLDQVLEQGGVS<br>SLLQNLAVSVTPILRIVRSGENALKIDIHVIIPYEGLSADQ<br>MAQIEEVFKVVYPVDDHHFKVILPYGTLVIDGVTPNMLN<br>YFGRPYEGIAVFDGKKITVTGTLWNGNKIIDERLITPD |

TABLE 1-continued

Exemplary peptide, dipeptide, and polypeptide sequences.

| SEQ ID NO | Name | Sequence |
|---|---|---|
| 365 | LgTrip 2899 (LgTrip 2098+Q42L) | atgaaacatcaccatcaccatcatgtcttcacactcgaagatttcgttggggactgggaaca gaccgccgcctacaacctggaccaagtccttgaacagggaggtgtgtccagtttgctgca gaatctcgccgtgtccgtaactccgatcctaaggattgtccggagcggtgaaaatgccctg aagatcgacatccatgtcatcatcccgtatgaaggtctgagcgccgaccaaatggcccag atcgaagaggtgtttaaggtggtgtaccctgtggatgatcatcactttaaggtgatcctgcc ctatggcacactggtaatcgacgggggttacgccaacatgctgaactatttcggacggcc gtatgaaggcatcgccgtgttcgacggcaaaaagatcactgtaacagggaccctgtgga acggcaacaaaattatcgacgagcgcctgatcaccccgac |
| 820 | ATG-3930 | atgAAACATCACCATCACCATCATgtcTTCACACTCGACG ATTTCGTTGGGGACTGGGAACAGACAGCCGCCTACAA CCTGGACCAAGTCCTTGAACAGGGAGGTGTGTCCAGT TTGCTGCAGAATCTCGCCGTGTCCGTAACTCCGATCAT GAGGATTGTCCGGAGCGGTGAAAATGCCCTGAAGATC GACATCCATGTCATCATCCCGTATGAAGGTCTGAGCG CCGACCAAATGGCCCAGATCGAAGAGGTGTTTAAGGT GGTGTACCCTGTGGATGATCATCACTTTAAGGTGATCC TGCCCTATGGCACACTGGTAATCGACGGGGTTACGCC GAACAAGCTGAACTATTTCGGACGGCCGTATGAAGGC ATCGCCGTGTTCGACGGCTAA |
| 821 | ATG-3930 | MKHHHHHHVFTLDDFVGDWEQTAAYNLDQVLEQGGV SSLLQNLAVSVTPIMRIVRSGENALKIDIHVIIPYEGLSAD QMAQIEEVFKVVYPVDDHHFKVILPYGTLVIDGVTPNKL NYFGRPYEGIAVFDG |
| 822 | SmTrip9-15GS-ProteinG (ATG 4002) | gggagctccGGTGGTGGCGGGAGCGGAGGTGGAGGctcgAG CGGTATGACGTATAAGTTAATCCTTAATGGTAAAACA TTGAAAGGCGAGACAACTACTGAAGCTGTTGATGCTG CTACTGCAGAAAAAGTCTTCAAACAATACGCTAACGA CAACGGTGTTGACGGTGAATGGACTTACGACGATGCG ACGAAAACCTTTACGGTCACCGAAAAACCAGAAGTGA TCGATGCGTCTGAATTAACACCAGCCGTGACAACTTA CAAACTTGTTATTAATGGTAAAACATTGAAAGGCGAA ACAACTACTGAGGCTGTTGATGCTGCTACTGCAGAGA AGGTGTTCAAACAATATGCGAATGACAACGGTGTTGA CGGTGAGTGGACTTACGACGATGCGACTAAGACCTTT ACAGTTACTGAAAAACCAGAAGTGATCGATGCGTCTG AGTTAACACCAGCCGTGACAACTTACAAACTTGTTATT AATGGTAAAACATTGAAAGGCGAAACAACTACTAAA GCAGTAGACGCAGAAACTGCGGAGAAGGCCTTCAAA CAATACGCTAACGACAACGGTGTTGATGGTGTTTGGA CTTATGATGATGCCACAAAAACCTTTACGGTAACTGA GCATCATCACCATCACCACTAA |
| 823 | SmTrip9-15GS-ProteinG (ATG 4002) | GSSGGGGSGGGGSSGMTYKLILNGKTLKGETTTEAVDA ATAEKVFKQYANDNGVDGEWTYDDATKTFTVTEKPEVI DASELTPAVTTYKLVINGKTLKGETTTEAVDAATAEKVF KQYANDNGVDGEWTYDDATKTFTVTEKPEVIDASELTP AVTTYKLVINGKTLKGETTTKAVDAETAEKAFKQYAND NGVDGVWTYDDATKTFTVTEHHHHHH |
| 830 | ATG-3929 | atgAAACATCACCATCACCATCATgtcTTCACACTCGACG ATTTCGTTGGGGACTGGGAACAGACAGCCGCCTACAA CCTGGACCAAGTCCTTGAACAGGGAGGTGTGTCCAGT TTGCTGCAGAATCTCGCCGTGTCCGTAACTCCGATCAT GAGGATTGTCCGGAGCGGTGAAAATGCCCTGAAGATC GACATCCATGTCATCATCCCGTATGAAGGTCTGAGCG CCGACCAAATGGCCCAGATCGAAGAGGTGTTTAAGGT GGTGTACCCTGTGGATGATCATCACTTTAAGGTGATCC TGCCCTATGGCACACTGGTAATCGACGGGGTTACGCC GAACAAGCTGAACTATTTCGGATAA |
| 831 | ATG-3929 | Mkhhhhhhvftlddfvgdweqtaaynldqvleqggvssllqnlavsvtpimrivrsg enalkidihviipyeglsadqmaqieevfkvvypvddhhfkvilpygtlvidgvtpnk lnyfg |
| 832 | ATG-3930 | atgAAACATCACCATCACCATCATgtcTTCACACTCGACG ATTTCGTTGGGGACTGGGAACAGACAGCCGCCTACAA CCTGGACCAAGTCCTTGAACAGGGAGGTGTGTCCAGT TTGCTGCAGAATCTCGCCGTGTCCGTAACTCCGATCAT GAGGATTGTCCGGAGCGGTGAAAATGCCCTGAAGATC GACATCCATGTCATCATCCCGTATGAAGGTCTGAGCG CCGACCAAATGGCCCAGATCGAAGAGGTGTTTAAGGT |

TABLE 1-continued

Exemplary peptide, dipeptide, and polypeptide sequences.

| SEQ ID NO | Name | Sequence |
|---|---|---|
| | | GGTGTACCCTGTGGATGATCATCACTTTAAGGTGATCC<br>TGCCCTATGGCACACTGGTAATCGACGGGGTTACGCC<br>GAACAAGCTGAACTATTTCGGACGGCCGTATGAAGGC<br>ATCGCCGTGTTCGACGGCTAA |
| 833 | ATG-3930 | Mkhhhhhhvftlddfvgdweqtaaynldqvleqggvssllqnlavsvtpimrivrsg<br>enalkidihviipyeglsadqmaqieevfkvvypvddhhfkvilpygtlvidgvtpnk<br>lnyfgrpyegiavfdg |
| 834 | ATG-3931 | atgAAACATCACCATCACCATCATgtcTTCACACTCGACG<br>ATTTCGTTGGGGACTGGGAACAGACAGCCGCCTACAA<br>CCTGGACCAAGTCCTTGAACAGGGAGGTGTGTCCAGT<br>TTGCTGCAGAATCTCGCCGTGTCCGTAACTCCGATCAT<br>GAGGATTGTCCGGAGCGGTGAAAATGCCCTGAAGATC<br>GACATCCATGTCATCATCCCGTATGAAGGTCTGAGCG<br>CCGACCAAATGGCCCAGATCGAAGAGGTGTTTAAGGT<br>GGTGTACCCTGTGGATGATCATCACTTTAAGGTGATCC<br>TGCCCTATGGCACACTGGTAATCGACGGGGTTACGCC<br>GAACAAGCTGAACTATTTCGGACGGCCGTATGAAGGC<br>ATCGCCGTGTTCGACGGCAAAAAGATCACTACCACAG<br>GGACCCTGTAA |
| 835 | ATG-3931 | Mkhhhhhhvftlddfvgdweqtaaynldqvleqggvssllqnlavsvtpimrivrsg<br>enalkidihviipyeglsadqmaqieevfkvvypvddhhfkvilpygtlvidgvtpnk<br>lnyfgrpyegiavfdgkkitttgtl |
| 836 | ATG-3932 | atgAAACATCACCATCACCATCATgtcTTCACACTCGACG<br>ATTTCGTTGGGGACTGGGAACAGACAGCCGCCTACAA<br>CCTGGACCAAGTCCTTGAACAGGGAGGTGTGTCCAGT<br>TTGCTGCAGAATCTCGCCGTGTCCGTAACTCCGATCAT<br>GAGGATTGTCCGGAGCGGTGAAAATGCCCTGAAGATC<br>GACATCCATGTCATCATCCCGTATGAAGGTCTGAGCG<br>CCGACCAAATGGCCCAGATCGAAGAGGTGTTTAAGGT<br>GGTGTACCCTGTGGATGATCATCACTTTAAGGTGATCC<br>TGCCCTATGGCACACTGGTAATCGACGGGGTTACGCC<br>GAACAAGCTGAACTATTTCGGACGGCCGTATGAAGGC<br>ATCGCCGTGTTCGACGGCAAAAAGATCACTACCACAG<br>GGACCCTGTGGAACGGCTAA |
| 837 | ATG-3932 | Mkhhhhhhvftlddfvgdweqtaaynldqvleqggvssllqnlavsvtpimrivrsg<br>enalkidihviipyeglsadqmaqieevfkvvypvddhhfkvilpygtlvidgvtpnk<br>lnyfgrpyegiavfdgkkitttgtlwng |
| 838 | ATG-4808 | Atggtttccgtgagcggctggcggctgttcaagaagattagcttcacactcgacgatttcg<br>ttggggactgggaacagacagccgcctacaacctggaccaagtccttgaacagggagg<br>tgtgtccagtttgctgcagaatctcgccgtgtccgtaactccgatcatgaggattgtccgga<br>gcggtgaaaatgccctgaagatcgacatccatgtcatcatcccgtatgaaggtctgagcg<br>ccgaccaaatggcccagatcgaagaggtgtttaaggtggtgtaccctgtggatgatcatc<br>actttaaggtgatcctgcccctatggcacactggtaatcgacggggttacgccgaacaagct<br>gaactatttcggacggccgtatgaaggcatcgccgtgttcgacggcaaaaagatcactac<br>cacagggaccctgtggaacggcaacaaaattatcgacgagcgcctgatcaccccgact<br>aa |
| 839 | ATG-4808 | Mvsvsgwrlfkkisftlddfvgdweqtaaynldqvleqggvssllqnlavsvtpimri<br>vrsgenalkidihviipyeglsadqmaqieevfkvvypvddhhfkvilpygtlvidgv<br>tpnklnyfgrpyegiavfdgkkitttgtlwngnkiiderlitpd |
| 840 | ATG-4809 | Atggtttccgtgagcggctggcggctgttcaagaagattagcggcagctccggtttcaca<br>ctcgacgatttcgttggggactgggaacagacagccgcctacaacctggaccaagtcctt<br>gaacagggaggtgtgtccagtttgctgcagaatctcgccgtgtccgtaactccgatcatga<br>ggattgtccggagcggtgaaaatgccctgaagatcgacatccatgtcatcatcccgtatga<br>aggtctgagcgccgaccaaatggcccagatcgaagaggtgtttaaggtggtgtaccctgt<br>ggatgatcatcactttaaggtgatcctgcccctatggcacactggtaatcgacggggttacg<br>ccgaacaagctgaactatttcggacggccgtatgaaggcatcgccgtgttcgacggcaa<br>aaagatcactaccacagggaccctgtggaacggcaacaaaattatcgacgagcgcctga<br>tcaccccgactaa |
| 841 | ATG-4809 | MVSVSGWRLFKKISGSSGFTLDDFVGDWEQTAAYNLDQ<br>VLEQGGVSSLLQNLAVSVTPIMRIVRSGENALKIDIHVIIP<br>YEGLSADQMAQIEEVFKVVYPVDDHHFKVILPYGTLVID<br>GVTPNKLNYFGRPYEGIAVFDGKKITTTGTLWNGNKIID<br>ERLITPD |

TABLE 1-continued

Exemplary peptide, dipeptide, and polypeptide sequences.

| SEQ ID NO | Name | Sequence |
|---|---|---|
| 842 | ATG-4810 | Atggtttccgtgagcggctggcggctgttcaagaagattagcggctcgagcggtggctc gagcggtttcacactcgacgatttcgttggggactgggaacagacagccgcctacaacct ggaccaagtccttgaacagggaggtgtgtccagtttgctgcagaatctcgccgtgtccgta actccgatcatgaggattgtccggagcggtgaaaatgccctgaagatcgacatccatgtc atcatcccgtatgaaggtctgagcgccgaccaaatggcccagatcgaagaggtgtttaag gtggtgtaccctgtggatgatcatcactttaaggtgatcctgccctatggcacactggtaatc gacggggttacgccgaacaagctgaactatttcggacggccgtatgaaggcatcgccgt gttcgacggcaaaaagatcactaccacagggaccctgtggaacggcaacaaaattatcg acgagcgcctgatcacccccgactaa |
| 843 | ATG-4810 | MVSVSGWRLFKKISGSSGGSSGFTLDDFVGDWEQTAAY NLDQVLEQGGVSSLLQNLAVSVTPIMRIVRSGENALKIDI HVIIPYEGLSADQMAQIEEVFKVVYPVDDHHFKVILPYG TLVIDGVTPNKLNYFGRPYEGIAVFDGKKITTTGTLWNG NKIIDERLITPD |
| 844 | ATG-4811 | Atggtttccgtgagcggctggcggctgttcaagaagattagcggctcgagcggtggctc gagcggtggctcgagcggtttcacactcgacgatttcgttggggactgggaacagacag ccgcctacaacctggaccaagtccttgaacagggaggtgtgtccagtttgctgcagaatct cgccgtgtccgtaactccgatcatgaggattgtccggagcggtgaaaatgccctgaagat cgacatccatgtcatcatcccgtatgaaggtctgagcgccgaccaaatggcccagatcga agaggtgtttaaggtggtgtaccctgtggatgatcatcactttaaggtgatcctgccctatgg cacactggtaatcgacggggttacgccgaacaagctgaactatttcggacggccgtatga aggcatcgccgtgttcgacggcaaaaagatcactaccacagggaccctgtggaacggc aacaaaattatcgacgagcgcctgatcacccccgactaa |
| 845 | ATG-4811 | MVSVSGWRLFKKISGSSGGSSGGSSGFTLDDFVGDWEQ TAAYNLDQVLEQGGVSSLLQNLAVSVTPIMRIVRSGENA LKIDIHVIIPYEGLSADQMAQIEEVFKVVYPVDDHHFKVI LPYGTLVIDGVTPNKLNYFGRPYEGIAVFDGKKITTTGTL WNGNKIIDERLITPD |
| 846 | ATG-4812 | Atggtttccgtgagcggctggcggctgttcaagaagattagcggctcgagcggtggctc gagcggtggctcgagcggtggctcgagcggtttcacactcgacgatttcgttggggactg ggaacagacagccgcctacaacctggaccaagtccttgaacagggaggtgtgtccagtt tgctgcagaatctcgccgtgtccgtaactccgatcatgaggattgtccggagcggtgaaa atgccctgaagatcgacatccatgtcatcatcccgtatgaaggtctgagcgccgaccaaat ggcccagatcgaagaggtgtttaaggtggtgtaccctgtggatgatcatcactttaaggtg atcctgccctatggcacactggtaatcgacggggttacgccgaacaagctgaactatttcg gacggccgtatgaaggcatcgccgtgttcgacggcaaaaagatcactaccacagggac cctgtggaacggcaacaaaattatcgacgagcgcctgatcacccccgactaa |
| 847 | ATG-4812 | MVSVSGWRLFKKISGSSGGSSGGSSGGSSGFTLDDFVGD WEQTAAYNLDQVLEQGGVSSLLQNLAVSVTPIMRIVRS GENALKIDIHVIIPYEGLSADQMAQIEEVFKVVYPVDDH HFKVILPYGTLVIDGVTPNKLNYFGRPYEGIAVFDGKKIT TTGTLWNGNKIIDERLITPD |
| 848 | ATG-4813 | Atggtttccgtgagcggctggcggctgttcaagaagattagcggctcgagcggtggctc gagcggtggctcgagcggtggctcgagcggtggctcgagcggtttcacactcgacgatt tcgttggggactgggaacagacagccgcctacaacctggaccaagtccttgaacaggga ggtgtgtccagtttgctgcagaatctcgccgtgtccgtaactccgatcatgaggattgtccg gagcggtgaaaatgccctgaagatcgacatccatgtcatcatcccgtatgaaggtctgag cgccgaccaaatggcccagatcgaagaggtgtttaaggtggtgtaccctgtggatgatca tcactttaaggtgatcctgccctatggcacactggtaatcgacggggttacgccgaacaag ctgaactatttcggacggccgtatgaaggcatcgccgtgttcgacggcaaaaagatcact accacagggaccctgtggaacggcaacaaaattatcgacgagcgcctgatcacccccg actaa |
| 849 | ATG-4813 | MVSVSGWRLFKKISGSSGGSSGGSSGGSSGGSSGFTLDD FVGDWEQTAAYNLDQVLEQGGVSSLLQNLAVSVTPIMR IVRSGENALKIDIHVIIPYEGLSADQMAQIEEVFKVVYPV DDHHFKVILPYGTLVIDGVTPNKLNYFGRPYEGIAVFDG KKITTTGTLWNGNKIIDERLITPD |
| 850 | ATG-4814 | Atggtgagcggctggcggctgttcaagaagattagcggctcgagcggtggctcgagcg gtggctcgagcggtggctcgagcggtggctcgagcggtttcacactcgacgatttcgttg gggactgggaacagacagccgcctacaacctggaccaagtccttgaacagggaggtgt gtccagtttgctgcagaatctcgccgtgtccgtaactccgatcatgaggattgtccggagc ggtgaaaatgccctgaagatcgacatccatgtcatcatcccgtatgaaggtctgagcgcc gaccaaatggcccagatcgaagaggtgtttaaggtggtgtaccctgtggatgatcatcact |

TABLE 1-continued

Exemplary peptide, dipeptide, and polypeptide sequences.

| SEQ ID NO | Name | Sequence |
|---|---|---|
| | | ttaaggtgatcctgccctatggcacactggtaatcgacggggttacgccgaacaagctga actatttcggacggccgtatgaaggcatcgccgtgttcgacggcaaaaagatcactacca cagggaccctgtggaacggcaacaaaattatcgacgagcgcctgatcaccccgactaa |
| 851 | ATG-4814 | MVSGWRLFKKISGSSGGSSGGSSGGSSGGSSGFTLDDFV GDWEQTAAYNLDQVLEQGGVSSLLQNLAVSVTPIMRIV RSGENALKIDIHVIIPYEGLSADQMAQIEEVFKVVYPVDD HHFKVILPYGTLVIDGVTPNKLNYFGRPYEGIAVFDGKKI TTTGTLWNGNKIIDERLITPD |
| 852 | ATG-4815 | Atggtcttcacactcgacgatttcgttggggactgggaacagacagccgcctacaacctg gaccaagtccttgaacaggaggtgtgtccagtttgctgcagaatctcgccgtgtccgtaa ctccgatcatgaggattgtccggagcggtgaaaatgccctgaagatcgacatccatgtcat catcccgtatgaaggtctgagcgccgaccaaatggcccagatcgaagaggtgtttaaggt ggtgtaccctgtggatgatcatcactttaaggtgatcctgccctatggcacactggtaatcg acggggttacgccgaacaagctgaactatttcggacggccgtatgaaggcatcgccgtgt tcgacggcaaaaagatcactaccacagggaccctgtggaacggcaacaaaattatcgac gagcgcctgatcaccccgacgtttccgtgagcggctggcggctgttcaagaagattagc taa |
| 853 | ATG-4815 | MVFTLDDFVGDWEQTAAYNLDQVLEQGGVSSLLQNLA VSVTPIMRIVRSGENALKIDIHVIIPYEGLSADQMAQIEEV FKVVYPVDDHHFKVILPYGTLVIDGVTPNKLNYFGRPYE GIAVFDGKKITTTGTLWNGNKIIDERLITPDVSVSGWRLF KKIS |
| 854 | ATG-4816 | Atggtcttcacactcgacgatttcgttggggactgggaacagacagccgcctacaacctg gaccaagtccttgaacaggaggtgtgtccagtttgctgcagaatctcgccgtgtccgtaa ctccgatcatgaggattgtccggagcggtgaaaatgccctgaagatcgacatccatgtcat catcccgtatgaaggtctgagcgccgaccaaatggcccagatcgaagaggtgtttaaggt ggtgtaccctgtggatgatcatcactttaaggtgatcctgccctatggcacactggtaatcg acggggttacgccgaacaagctgaactatttcggacggccgtatgaaggcatcgccgtgt tcgacggcaaaaagatcactaccacagggaccctgtggaacggcaacaaaattatcgac gagcgcctgatcaccccgacggctcgagcggtgtttccgtgagcggctggcggctgtt caagaagattagctaa |
| 855 | ATG-4816 | MVFTLDDFVGDWEQTAAYNLDQVLEQGGVSSLLQNLA VSVTPIMRIVRSGENALKIDIHVIIPYEGLSADQMAQIEEV FKVVYPVDDHHFKVILPYGTLVIDGVTPNKLNYFGRPYE GIAVFDGKKITTTGTLWNGNKIIDERLITPDGSSGVSVSG WRLFKKIS |
| 856 | ATG-4817 | Atggtcttcacactcgacgatttcgttggggactgggaacagacagccgcctacaacctg gaccaagtccttgaacaggaggtgtgtccagtttgctgcagaatctcgccgtgtccgtaa ctccgatcatgaggattgtccggagcggtgaaaatgccctgaagatcgacatccatgtcat catcccgtatgaaggtctgagcgccgaccaaatggcccagatcgaagaggtgtttaaggt ggtgtaccctgtggatgatcatcactttaaggtgatcctgccctatggcacactggtaatcg acggggttacgccgaacaagctgaactatttcggacggccgtatgaaggcatcgccgtgt tcgacggcaaaaagatcactaccacagggaccctgtggaacggcaacaaaattatcgac gagcgcctgatcaccccgacggctcgagcggtggctcgagcggtgtttccgtgagcg gctggcggctgttcaagaagattagctaa |
| 857 | ATG-4817 | MVFTLDDFVGDWEQTAAYNLDQVLEQGGVSSLLQNLA VSVTPIMRIVRSGENALKIDIHVIIPYEGLSADQMAQIEEV FKVVYPVDDHHFKVILPYGTLVIDGVTPNKLNYFGRPYE GIAVFDGKKITTTGTLWNGNKIIDERLITPDGSSGGSSGV SVSGWRLFKKIS |
| 858 | ATG-4818 | Atggtcttcacactcgacgatttcgttggggactgggaacagacagccgcctacaacctg gaccaagtccttgaacaggaggtgtgtccagtttgctgcagaatctcgccgtgtccgtaa ctccgatcatgaggattgtccggagcggtgaaaatgccctgaagatcgacatccatgtcat catcccgtatgaaggtctgagcgccgaccaaatggcccagatcgaagaggtgtttaaggt ggtgtaccctgtggatgatcatcactttaaggtgatcctgccctatggcacactggtaatcg acggggttacgccgaacaagctgaactatttcggacggccgtatgaaggcatcgccgtgt tcgacggcaaaaagatcactaccacagggaccctgtggaacggcaacaaaattatcgac gagcgcctgatcaccccgacgctcgagcggtggctcgagcggtgtgagcggctgg cggctgttcaagaagattagctaa |
| 859 | ATG-4818 | MVFTLDDFVGDWEQTAAYNLDQVLEQGGVSSLLQNLA VSVTPIMRIVRSGENALKIDIHVIIPYEGLSADQMAQIEEV FKVVYPVDDHHFKVILPYGTLVIDGVTPNKLNYFGRPYE GIAVFDGKKITTTGTLWNGNKIIDERLITPDGSSGGSSGV SGWRLFKKIS |

TABLE 1-continued

Exemplary peptide, dipeptide, and polypeptide sequences.

| SEQ ID NO | Name | Sequence |
|---|---|---|
| 860 | ATG-4819 | Atggtttccgtgagcggctggcggctgttcaagaagattagcttcacactcgacgatttcg ttggggactgggaacagacagccgcctacaacctggaccaagtccttgaacagggagg tgtgtccagtttgctgcagaatctcgccgtgtccgtaactccgatcatgaggattgtccgga gcggtgaaaatgccctgaagatcgacatccatgtcatcatcccgtatgaaggtctgagcg ccgaccaaatggcccagatcgaagaggtgtttaaggtggtgtaccctgtggatgatcatc actttaaggtgatcctgccctatggcacactggtaatcgacggggttacgccgaacaagct gaactatttcggacggccgtatgaaggcatcgccgtgttcgacggcaaaaagatcactac cacagggaccctgtggaacggcaacaaaattatcgacgagcgcctgatcaccccccgac catcaccatcaccatcattaa |
| 861 | ATG-4819 | MVSVSGWRLFKKISFTLDDFVGDWEQTAAYNLDQVLEQ GGVSSLLQNLAVSVTPIMRIVRSGENALKIDIHVIIPYEGL SADQMAQIEEVFKVVYPVDDHHFKVILPYGTLVIDGVTP NKLNYFGRPYEGIAVFDGKKITTTGTLWNGNKIIDERLIT PDHHHHHH |
| 862 | ATG-4820 | Atggtttccgtgagcggctggcggctgttcaagaagattagcggcagctccggtttcaca ctcgacgatttcgttggggactgggaacagacagccgcctacaacctggaccaagtcctt gaacagggaggtgtgtccagtttgctgcagaatctcgccgtgtccgtaactccgatcatga ggattgtccggagcggtgaaaatgccctgaagatcgacatccatgtcatcatcccgtatga aggtctgagcgccgaccaaatggcccagatcgaagaggtgtttaaggtggtgtaccctgt ggatgatcatcactttaaggtgatcctgccctatggcacactggtaatcgacggggttacg ccgaacaagctgaactatttcggacggccgtatgaaggcatcgccgtgttcgacggcaa aaagatcactaccacagggaccctgtggaacggcaacaaaattatcgacgagcgcctga tcaccccccgaccatcaccatcaccatcattaa |
| 863 | ATG-4820 | MVSVSGWRLFKKISGSSGFTLDDFVGDWEQTAAYNLDQ VLEQGGVSSLLQNLAVSVTPIMRIVRSGENALKIDIHVIIP YEGLSADQMAQIEEVFKVVYPVDDHHFKVILPYGTLVID GVTPNKLNYFGRPYEGIAVFDGKKITTTGTLWNGNKIID ERLITPDHHHHHH |
| 864 | ATG-4821 | Atggtttccgtgagcggctggcggctgttcaagaagattagcggctcgagcggtggctc gagcggtttcacactcgacgatttcgttggggactgggaacagacagccgcctacaacct ggaccaagtccttgaacagggaggtgtgtccagtttgctgcagaatctcgccgtgtccgta actccgatcatgaggattgtccggagcggtgaaaatgccctgaagatcgacatccatgtc atcatcccgtatgaaggtctgagcgccgaccaaatggcccagatcgaagaggtgtttaag gtggtgtaccctgtggatgatcatcactttaaggtgatcctgccctatggcacactggtaatc gacggggttacgccgaacaagctgaactatttcggacggccgtatgaaggcatcgccgt gttcgacggcaaaaagatcactaccacagggaccctgtggaacggcaacaaaattatcg acgagcgcctgatcaccccccgaccatcaccatcaccatcattaa |
| 865 | ATG-4821 | MVSVSGWRLFKKISGSSGGSSGFTLDDFVGDWEQTAAY NLDQVLEQGGVSSLLQNLAVSVTPIMRIVRSGENALKIDI HVIIPYEGLSADQMAQIEEVFKVVYPVDDHHFKVILPYG TLVIDGVTPNKLNYFGRPYEGIAVFDGKKITTTGTLWNG NKIIDERLITPDHHHHHH |
| 866 | ATG-4822 | Atggtttccgtgagcggctggcggctgttcaagaagattagcggctcgagcggtggctc gagcggtggctcgagcggtttcacactcgacgatttcgttggggactgggaacagacag ccgcctacaacctggaccaagtccttgaacagggaggtgtgtccagtttgctgcagaatct cgccgtgtccgtaactccgatcatgaggattgtccggagcggtgaaaatgccctgaagat cgacatccatgtcatcatcccgtatgaaggtctgagcgccgaccaaatggcccagatcga agaggtgtttaaggtggtgtaccctgtggatgatcatcactttaaggtgatcctgccctatgg cacactggtaatcgacggggttacgccgaacaagctgaactatttcggacggccgtatga aggcatcgccgtgttcgacggcaaaaagatcactaccacagggaccctgtggaacggc aacaaaattatcgacgagcgcctgatcaccccccgaccatcaccatcaccatcattaa |
| 867 | ATG-4822 | MVSVSGWRLFKKISGSSGGSSGGSSGFTLDDFVGDWEQ TAAYNLDQVLEQGGVSSLLQNLAVSVTPIMRIVRSGENA LKIDIHVIIPYEGLSADQMAQIEEVFKVVYPVDDHHFKVI LPYGTLVIDGVTPNKLNYFGRPYEGIAVFDGKKITTTGTL WNGNKIIDERLITPDHHHHHH |
| 868 | ATG-4823 | Atggtttccgtgagcggctggcggctgttcaagaagattagcggctcgagcggtggctc gagcggtggctcgagcggtggctcgagcggtttcacactcgacgatttcgttggggactg ggaacagacagccgcctacaacctggaccaagtccttgaacagggaggtgtgtccagtt tgctgcagaatctcgccgtgtccgtaactccgatcatgaggattgtccggagcggtgaaa atgccctgaagatcgacatccatgtcatcatcccgtatgaaggtctgagcgccgaccaaat ggcccagatcgaagaggtgtttaaggtggtgtaccctgtggatgatcatcactttaaggtg atcctgccctatggcacactggtaatcgacggggttacgccgaacaagctgaactatttcg gacggccgtatgaaggcatcgccgtgttcgacggcaaaaagatcactaccacagggac cctgtggaacggcaacaaaattatcgacgagcgcctgatcaccccccgaccatcaccatc accatcattaa |

TABLE 1-continued

Exemplary peptide, dipeptide, and polypeptide sequences.

| SEQ ID NO | Name | Sequence |
|---|---|---|
| 869 | ATG-4823 | MVSVSGWRLFKKISGSSGGSSGGSSGGSSGFTLDDFVGD WEQTAAYNLDQVLEQGGVSSLLQNLAVSVTPIMRIVRS GENALKIDIHVIIPYEGLSADQMAQIEEVFKVVYPVDDH HFKVILPYGTLVIDGVTPNKLNYFGRPYEGIAVFDGKKIT TTGTLWNGNKIIDERLITPDHHHHHH |
| 870 | ATG-4824 | Atggtgagcggctggcggctgttcaagaagattagcggctcgagcggtggctcgagcg gtggctcgagcggtggctcgagcggtggctcgagcggtttcacactcgacgatttcgttg gggactgggaacagacagccgcctacaacctggaccaagtccttgaacagggaggtgt gtccagtttgctgcagaatctcgccgtgtccgtaactccgatcatgaggattgtccggagc ggtgaaaatgccctgaagatcgacatccatgtcatcatcccgtatgaaggtctgagcgcc gaccaaatggcccagatcgaagaggtgtttaaggtggtgtaccctgtggatgatcatcact taaggtgatcctgccctatggcacactggtaatcgacggggttacgccgaacaagctga actatttcggacggccgtatgaaggcatcgccgtgttcgacggcaaaaagatcactacca cagggaccctgtggaacggcaacaaaattatcgacgagcgcctgatcaccccgaccat caccatcaccatcattaa |
| 871 | ATG-4824 | MVSGWRLFKKISGSSGGSSGGSSGGSSGGSSGFTLDDFV GDWEQTAAYNLDQVLEQGGVSSLLQNLAVSVTPIMRIV RSGENALKIDIHVIIPYEGLSADQMAQIEEVFKVVYPVDD HHFKVILPYGTLVIDGVTPNKLNYFGRPYEGIAVFDGKKI TTTGTLWNGNKIIDERLITPDHHHHHH |
| 872 | ATG-4825 | Atggtttccgtgagcggctggcggctgttcaagaagattagcggctcgagcggtggctc gagcggtggctcgagcggtggctcgagcggtttcacactcgacgatt tcgttggggactgggaacagacagccgcctacaacctggaccaagtccttgaacaggga ggtgtgtccagtttgctgcagaatctcgccgtgtccgtaactccgatcatgaggattgtccg gagcggtgaaaatgccctgaagatcgacatccatgtcatcatcccgtatgaaggtctgag cgccgaccaaatggcccagatcgaagaggtgtttaaggtggtgtaccctgtggatgatca tcactttaaggtgatcctgccctatggcacactggtaatcgacggggttacgccgaacaag ctgaactatttcggacggccgtatgaaggcatcgccgtgttcgacggcaaaaagatcact accacagggaccctgtggaacggcaacaaaattatcgacgagcgcctgatcaccccccg accatcaccatcaccatcattaa |
| 873 | ATG-4825 | MVSVSGWRLFKKISGSSGGSSGGSSGGSSGGSSGFTLDD FVGDWEQTAAYNLDQVLEQGGVSSLLQNLAVSVTPIMR IVRSGENALKIDIHVIIPYEGLSADQMAQIEEVFKVVYPV DDHHFKVILPYGTLVIDGVTPNKLNYFGRPYEGIAVFDG KKITTTGTLWNGNKIIDERLITPDHHHHHH |
| 874 | ATG-4826 | Atgaaacatcaccatcaccatcatgtcttcacactcgacgatttcgttggggactgggaac agacagccgcctacaacctggaccaagtccttgaacagggaggtgtgtccagtttgctgc agaatctcgccgtgtccgtaactccgatcatgaggattgtccggagcggtgaaaatgccct gaagatcgacatccatgtcatcatcccgtatgaaggtctgagcgccgaccaaatggccca gatcgaagaggtgtttaaggtggtgtaccctgtggatgatcactttaaggtgatcctgc cctatggcacactggtaatcgacggggttacgccgaacaagctgaactatttcggacggc cgtatgaaggcatcgccgtgttcgacggcaaaaagatcactaccacagggaccctgtgg aacggcaacaaaattatcgacgagcgcctgatcaccccccgacgtttccgtgagcggctg gcggctgttcaagaagattagctaa |
| 875 | ATG-4826 | MKHHHHHHVFTLDDFVGDWEQTAAYNLDQVLEQGGV SSLLQNLAVSVTPIMRIVRSGENALKIDIHVIIPYEGLSAD QMAQIEEVFKVVYPVDDHHFKVILPYGTLVIDGVTPNKL NYFGRPYEGIAVFDGKKITTTGTLWNGNKIIDERLITPDV SVSGWRLFKKIS |
| 876 | ATG-4827 | Atgaaacatcaccatcaccatcatgtcttcacactcgacgatttcgttggggactgggaac agacagccgcctacaacctggaccaagtccttgaacagggaggtgtgtccagtttgctgc agaatctcgccgtgtccgtaactccgatcatgaggattgtccggagcggtgaaaatgccct gaagatcgacatccatgtcatcatcccgtatgaaggtctgagcgccgaccaaatggccca gatcgaagaggtgtttaaggtggtgtaccctgtggatgatcactttaaggtgatcctgc cctatggcacactggtaatcgacggggttacgccgaacaagctgaactatttcggacggc cgtatgaaggcatcgccgtgttcgacggcaaaaagatcactaccacagggaccctgtgg aacggcaacaaaattatcgacgagcgcctgatcaccccccgacggctcgagcggtgtttc cgtgagcggctggcggctgttcaagaagattagctaa |
| 877 | ATG-4827 | MKHHHHHHVFTLDDFVGDWEQTAAYNLDQVLEQGGV SSLLQNLAVSVTPIMRIVRSGENALKIDIHVIIPYEGLSAD QMAQIEEVFKVVYPVDDHHFKVILPYGTLVIDGVTPNKL NYFGRPYEGIAVFDGKKITTTGTLWNGNKIIDERLITPDG SSGVSVSGWRLFKKIS |

TABLE 1-continued

Exemplary peptide, dipeptide, and polypeptide sequences.

| SEQ ID NO | Name | Sequence |
|---|---|---|
| 878 | ATG-4828 | Atgaaacatcaccatcaccatcatgtcttcacactcgacgatttcgttggggactgggaac agacagccgcctacaacctggaccaagtccttgaacagggaggtgtgtccagtttgctgc agaatctcgccgtgtccgtaactccgatcatgaggattgtccggagcggtgaaaatgccct gaagatcgacatccatgtcatcatcccgtatgaaggtctgagcgccgaccaaatggccca gatcgaagaggtgtttaaggtggtgtaccctgtggatgatcatcactttaaggtgatcctgc cctatggcacactggtaatcgacggggttacgccgaacaagctgaactatttcggacggc cgtatgaaggcatcgccgtgttcgacggcaaaaagatcactaccacagggaccctgtgg aacggcaacaaaattatcgacgagcgcctgatcaccccgacggctcgagcggtggct cgagcggtgtgagcggctggcggctgttcaagaagattagctaa |
| 879 | ATG-4828 | MKHHHHHHVFTLDDFVGDWEQTAAYNLDQVLEQGGV SSLLQNLAVSVTPIMRIVRSGENALKIDIHVIIPYEGLSAD QMAQIEEVFKVVYPVDDHHFKVILPYGTLVIDGVTPNKL NYFGRPYEGIAVFDGKKITTTGTLWNGNKIIDERLITPDG SSGGSSGVSGWRLFKKIS |
| 880 | ATG-4829 | Atgaaacatcaccatcaccatcatgtcttcacactcgacgatttcgttggggactgggaac agacagccgcctacaacctggaccaagtccttgaacagggaggtgtgtccagtttgctgc agaatctcgccgtgtccgtaactccgatcatgaggattgtccggagcggtgaaaatgccct gaagatcgacatccatgtcatcatcccgtatgaaggtctgagcgccgaccaaatggccca gatcgaagaggtgtttaaggtggtgtaccctgtggatgatcatcactttaaggtgatcctgc cctatggcacactggtaatcgacggggttacgccgaacaagctgaactatttcggacggc cgtatgaaggcatcgccgtgttcgacggcaaaaagatcactaccacagggaccctgtgg aacggcaacaaaattatcgacgagcgcctgatcaccccgacggctcgagcggtggct cgagcggtgtttccgtgagcggctggcggctgttcaagaagattagctaa |
| 881 | ATG-4829 | MKHHHHHHVFTLDDFVGDWEQTAAYNLDQVLEQGGV SSLLQNLAVSVTPIMRIVRSGENALKIDIHVIIPYEGLSAD QMAQIEEVFKVVYPVDDHHFKVILPYGTLVIDGVTPNKL NYFGRPYEGIAVFDGKKITTTGTLWNGNKIIDERLITPDG SSGGSSGVSVSGWRLFKKIS |
| 882 | ATG-2623 | atggtcttcacactcgaagatttcgttggggactgggaacagacagccgcctacaacctg gaccaagtccttgaacagggaggtgtgtccagtttgctgcagaatctcgccgtgtccgtaa ctccgatccaaaggattgtccggagcggtgaaaatgccctgaagatcgacatccatgtca tcatcccgtatgaaggtctgagcgccgaccaaatggcccagatcgaagaggtgtttaagg tggtgtaccctgtggatgatcatcactttaaggtgatcctgcccctatggcacactggtaatcg acggggttacgccgaacatgctgaactatttcggacggccgtatgaaggcatcgccgtgt tcgacggcaaaaagatcactgtaacagggaccctgtggaacggcaacaaaattatcgac gagcgcctgatcaccccgacggctccatgctgttccgagtaaccatcaacagccatcat caccatcaccactaa |
| 883 | ATG-2623 | MVFTLEDFVGDWEQTAAYNLDQVLEQGGVSSLLQNLA VSVTPIQRIVRSGENALKIDIHVIIPYEGLSADQMAQIEEV FKVVYPVDDHHFKVILPYGTLVIDGVTPNMLNYFGRPYE GIAVFDGKKITVTGTLWNGNKIIDERLITPDGSMLFRVTI NSHHHHHH |
| 884 | ATG-3745 | atggtgagcggctggcggctgttcaagaagattagccaccatcaccatcaccatcatcact tcacactcgacgatttcgttggggactgggaacagacagccgcctacaacctggaccaa gtccttgaacagggaggtgtgtccagtttgctgcagaatctcgccgtgtccgtaactccgat catgaggattgtccggagcggtgaaaatgccctgaagatcgacatccatgtcatcatccc gtatgaaggtctgagcgccgaccaaatggcccagatcgaagaggtgtttaaggtggtgta ccctgtggatgatcatcactttaaggtgatcctgcccctatggcacactggtaatcgacggg gttacgccgaacaagctgaactatttcggacggccgtatgaaggcatcgccgtgttcgac ggcaaaaagatcactaccacagggaccctgtggaacggcaacaaaattatcgacgagc gcctgatcaccccgactaa |
| 885 | ATG-3745 | MVSGWRLFKKISHHHHHHHHFTLDDFVGDWEQTAAYN LDQVLEQGGVSSLLQNLAVSVTPIMRIVRSGENALKIDIH VIIPYEGLSADQMAQIEEVFKVVYPVDDHHFKVILPYGTL VIDGVTPNKLNYFGRPYEGIAVFDGKKITTTGTLWNGNK IIDERLITPD |
| 886 | ATG-3746 | atgaaacatcaccatcaccatcatgtgagcggctggcggctgttcaagaagattagcggc agctccggtttcacactcgacgatttcgttggggactgggaacagacagccgcctacaac ctggaccaagtccttgaacagggaggtgtgtccagtttgctgcagaatctcgccgtgtccg taactccgatcatgaggattgtccggagcggtgaaaatgccctgaagatcgacatccatgt catcatcccgtatgaaggtctgagcgccgaccaaatggcccagatcgaagaggtgtttaa ggtggtgtaccctgtggatgatcatcactttaaggtgatcctgcccctatggcacactggtaa tcgacggggttacgccgaacaagctgaactatttcggacggccgtatgaaggcatcgcc gtgttcgacggcaaaaagatcactaccacagggaccctgtggaacggcaacaaaattat cgacgagcgcctgatcaccccgactaa |

TABLE 1-continued

Exemplary peptide, dipeptide, and polypeptide sequences.

| SEQ ID NO | Name | Sequence |
|---|---|---|
| 887 | ATG-3746 | MKHHHHHHVSGWRLFKKISGSSGFTLDDFVGDWEQTA<br>AYNLDQVLEQGGVSSLLQNLAVSVTPIMRIVRSGENALK<br>IDIHVIIPYEGLSADQMAQIEEVFKVVYPVDDHHFKVILP<br>YGTLVIDGVTPNKLNYFGRPYEGIAVFDGKKITTTGTLW<br>NGNKIIDERLITPD |
| 888 | ATG-4632 | atggtgagcggctggcggctgttcaagaagattagcggcagctccggtttcacactcgac<br>gatttcgttggggactgggaacagacagccgcctacaaacctggaccaagtccttgaaca<br>gggaggtgtgtccagtttgctgcagaatctcgccgtgtccgtaactccgatcatgaggatt<br>gtccggagcggtgaaaatgccctgaagatcgacatccatgtcatcatcccgtatgaaggt<br>ctgagcgccgaccaaatggcccagatcgaagaggtgtttaaggtggtgtaccctgtggat<br>gatcatcactttaaggtgatcctgccctatggcacactggtaatcgacggggttacgccga<br>acaagctgaactatttcggacggccgtatgaaggcatcgccgtgttcgacggcaaaaag<br>atcactaccacagggaccctgtggaacggcaacaaaattatcgacgagcgcctgatcac<br>ccccgaccatcaccatcaccatcattaa |
| 889 | ATG-4632 | MVSGWRLFKKISGSSGFTLDDFVGDWEQTAAYNLDQVL<br>EQGGVSSLLQNLAVSVTPIMRIVRSGENALKIDIHVIIPYE<br>GLSADQMAQIEEVFKVVYPVDDHHFKVILPYGTLVIDGV<br>TPNKLNYFGRPYEGIAVFDGKKITTTGTLWNGNKIIDERL<br>ITPDHHHHHH |
| 890 | ATG-2757 | atggtcttcacactcgaagatttcgttggggactgggaacagacagccgcctacaacctg<br>gaccaagtccttgaacaggaggtgtgtccagtttgctgcagaatctcgccgtgtccgtaa<br>ctccgatccaaaggattgtccggagcggtgaaaatgccctgaagatcgacatccatgtca<br>tcatcccgtatgaaggtctgagcgccgaccaaatggcccagatcgaagaggtgtttaagg<br>tggtgtaccctgtggatgatcatcactttaaggtgatcctgccctatggcacactggtaatcg<br>acggggttacgccgaacatgctgaactatttcggacggccgtatgaaggcatcgccgtgt<br>tcgacggcaaaaagatcactgtaacagggaccctgtggaacgagaacaaaattatcgac<br>gagcgcctgatcaccccgacggctccatgctgttccgagtaaccatcaacagccatcat<br>caccatcaccactaa |
| 891 | ATG-2757 | MVFTLEDFVGDWEQTAAYNLDQVLEQGGVSSLLQNLA<br>VSVTPIQRIVRSGENALKIDIHVIIPYEGLSADQMAQIEEV<br>FKVVYPVDDHHFKVILPYGTLVIDGVTPNMLNYFGRPYE<br>GIAVFDGKKITVTGTLWNENKIIDERLITPDGSMLFRVTI<br>NSHHHHHH |
| 892 | ATG-2760 | atggtcttcacactcgaagatttcgttggggactgggaacagacagccgcctacaacctg<br>gaccaagtccttgaacaggaggtgtgtccagtttgctgcagaatctcgccgtgtccgtaa<br>ctccgatccaaaggattgtccggagcggtgaaaatgccctgaagatcgacatccatgtca<br>tcatcccgtatgaaggtctgagcgccgaccaaatggcccagatcgaagaggtgtttaagg<br>tggtgtaccctgtggatgatcatcactttaaggtgatcctgccctatggcacactggtaatcg<br>acggggttacgccgaacatgctgaactatttcggacggccgtatgaaggcatcgccgtgt<br>tcgacggcaaaaagatcactgtaacagggaccctgtggaacggcgttaaaattatcgacg<br>agcgcctgatcaccccgacggctccatgctgttccgagtaaccatcaacagccatcatc<br>accatcaccactaa |
| 893 | ATG-2760 | MVFTLEDFVGDWEQTAAYNLDQVLEQGGVSSLLQNLA<br>VSVTPIQRIVRSGENALKIDIHVIIPYEGLSADQMAQIEEV<br>FKVVYPVDDHHFKVILPYGTLVIDGVTPNMLNYFGRPYE<br>GIAVFDGKKITVTGTLWNGVKIIDERLITPDGSMLFRVTI<br>NSHHHHHH |
| 894 | ATG-3882 | atggtcttcacactcgaagatttcgttggggactgggaacagacagccgcctacaacctg<br>gaccaagtccttgaacaggaggtgtgtccagtttgctgcagaatctcgccgtgtccgtaa<br>ctccgatccaaaggatggtccggagcggtgaaaatgccctgaagatcgacatccatgtca<br>tcatcccgtatgaaggtctgagcgccgaccaaatggcccagatcgaagaggtgtttaagg<br>tggtgtaccctgtggatgatcatcactttaaggtgatcctgccctatggcacactggtaatcg<br>acggggttacgccgaacatgctgaactatttcggacggccgtatgaaggcatcgccgtgt<br>tcgacggcaaaaagatcactgtaacagggaccctgtggaacggcaacaaaattatcgac<br>gagcgcctgatcaccccgacggctccatgctgttccgagtaaccatcaacagccatcat<br>caccatcaccactaa |
| 895 | ATG-3882 | MVFTLEDFVGDWEQTAAYNLDQVLEQGGVSSLLQNLA<br>VSVTPIQRMVRSGENALKIDIHVIIPYEGLSADQMAQIEE<br>VFKVVYPVDDHHFKVILPYGTLVIDGVTPNMLNYFGRP<br>YEGIAVFDGKKITVTGTLWNGNKIIDERLITPDGSMLFRV<br>TINSHHHHHH |
| 896 | ATG-3901 | atggtcttcacactcgaagatttcgttggggactggaagcagacagccgcctacaacctg<br>gaccaagtccttgaacaggaggtgtgtccagtttgctgcagaatctcgccgtgtccgtaa<br>ctccgatccaaaggatggtccggagcggtgaaaatgccctgaagatcgacatccatgtca |

TABLE 1-continued

Exemplary peptide, dipeptide, and polypeptide sequences.

| SEQ ID NO | Name | Sequence |
|---|---|---|
| | | tcatcccgtatgaaggtctgagcgccgaccaaatggcccagatcgaagaggtgtttaagg<br>tggtgtaccctgtggatgatcatcactttaaggtgatcctgccctatggcacactggtaatcg<br>acggggttacgccgaacatgctgaactatttcggacggccgtatgaaggcatcgccgtgt<br>tcgacggcaaaaagatcactgtaacagggaccctgtggaacggcaacaaaattatcgac<br>gagcgcctgatcacccccgacggctccatgctgttccgagtaaccatcaacagccatcat<br>caccatcaccactaa |
| 897 | ATG-3901 | MVFTLEDFVGDWKQTAAYNLDQVLEQGGVSSLLQNLA<br>VSVTPIQRMVRSGENALKIDIHVIIPYEGLSADQMAQIEE<br>VFKVVYPVDDHHFKVILPYGTLVIDGVTPNMLNYFGRP<br>YEGIAVFDGKKITVTGTLWNGNKIIDERLITPDGSMLFRV<br>TINSHHHHHH |
| 898 | ATG-3945 | atggtcttcacactcgaagatttcgttggggactggaagcagacagccgcctacaacctg<br>gaccaagtccttgaacaggaggtgtgtccagtttgctgcagaatctcgccgtgtccgtaa<br>ctccgatccaaaggatggtccggagcggtgaaaatgccctgaagatcgacatccatgtca<br>tcatcccgtatgaaggtctgagcgccgaccaaatggcccagatcgaagaggtgtttaagg<br>tggtgtaccctgtggatgatcatcactttaaggtgatcctgccctatggcacactggtaatcg<br>acggggttacgccgaacatgctgaactatttcggacggccgtatgaaggcatcgccgtgt<br>tcgacggcaaaaagatcactgtaacagggaccctgtggaacgcgtcaaaattatcgac<br>gagcgcctgatcacccccgacggctccatgctgttccgagtaaccatcaacagccatcat<br>caccatcaccactaa |
| 899 | ATG-3945 | MVFTLEDFVGDWKQTAAYNLDQVLEQGGVSSLLQNLA<br>VSVTPIQRMVRSGENALKIDIHVIIPYEGLSADQMAQIEE<br>VFKVVYPVDDHHFKVILPYGTLVIDGVTPNMLNYFGRP<br>YEGIAVFDGKKITVTGTLWNDVKIIDERLITPDGSMLFRV<br>TINSHHHHHH |
| 890 | ATG-3984 | atggtcttcacactcgaagatttcgttggggactggaagcagacagccgcctacaacctg<br>gaccaagtccttgaacaggaggtgtgtccagtttgctgcagaatctcgccgtgtccgtaa<br>ctccgatccaaaggatggtccggagcggtgaaaatgccctgaagatcgacatccatgtca<br>tcatcccgtatgaaggtctgagcgccgaccaaatggcccagatcgaagaggtgtttaagg<br>tggtgtaccctgtggatgatcatcactttaaggtgatcctgccctatggcacactggtaatcg<br>acggggttacgccgaacatgctgaactatttcggacggccgtatgaaggcatcgccgtgt<br>tcgacggcaaaaagatcactgtaacagggaccctgtggaacgacgtcaaaattatcgac<br>gagcgcctgatcacccccgacggctccatgtccttccgagtaaccatcaacagccatcat<br>caccatcaccactaa |
| 891 | ATG-3984 | MVFTLEDFVGDWKQTAAYNLDQVLEQGGVSSLLQNLA<br>VSVTPIQRMVRSGENALKIDIHVIIPYEGLSADQMAQIEE<br>VFKVVYPVDDHHFKVILPYGTLVIDGVTPNMLNYFGRP<br>YEGIAVFDGKKITVTGTLWNDVKIIDERLITPDGSMSFRV<br>TINSHHHHHH |
| 892 | ATG-4147 | atggtcttcacactcgaagatttcgttggggactggaagcagacagccgcctacaacctg<br>gaccaagtccttgaacaggaggtgtgtccagtttgctgcagaatctcgccgtgtccgtaa<br>ctccgatccaaaggatggtccggagcggtgaaaatgccctgaagatcgacatccatgtca<br>tcatcccgtatgaaggtctgagcgccgaccaaatggcccagatcgaagaggtgtttaagg<br>tggtgtaccctgtggatgatcatcactttaaggtgatcctgccctatggcacactggtaatcg<br>acggggttacgccgaacatgctgaactatttcggacggccgtatgaaggcatcgccgtgt<br>tcgacggcaaaaagatcactgtaacagggaccctgtggaacggcaacaaaattatcgac<br>gagcgcctgatcacccccgacggctccatgtccttccgagtaaccatcaacagccatcat<br>caccatcaccactaa |
| 893 | ATG-4147 | MVFTLEDFVGDWKQTAAYNLDQVLEQGGVSSLLQNLA<br>VSVTPIQRMVRSGENALKIDIHVIIPYEGLSADQMAQIEE<br>VFKVVYPVDDHHFKVILPYGTLVIDGVTPNMLNYFGRP<br>YEGIAVFDGKKITVTGTLWNGNKIIDERLITPDGSMSFRV<br>TINSHHHHHH |
| 894 | ATG-4166 | atggtcttcacactcgaagatttcgttggggactggaagcagacagccgcctacaacctg<br>gaccaagtccttgaacaggaggtgtgtccagtttgctgcagaatctcgccgtgtccgtaa<br>ctccgatccaaaggatggtccggagcggtgaaaatgccctgaagatcgacatccatgtca<br>tcatcccgtatgaaggtctgagcgccgaccaaatggcccagatcgaagaggtgtttaagg<br>tggtgtaccctgtggatgatcatcactttaaggtgatcctgccctatggcacactggtaatcg<br>acggggttacgccgaacatgctgaactatttcggacggccgtatgaaggcatcgccgtgt<br>tcgacggcaaaaagatcactgtaacagggaccctgtggaacggcgtcaaaattatcgac<br>gagcgcctgatcacccccgacggctccatgtccttccgagtaaccatcaacagccatcat<br>caccatcaccactaa |
| 895 | ATG-4166 | MVFTLEDFVGDWKQTAAYNLDQVLEQGGVSSLLQNLA<br>VSVTPIQRMVRSGENALKIDIHVIIPYEGLSADQMAQIEE<br>VFKVVYPVDDHHFKVILPYGTLVIDGVTPNMLNYFGRP |

TABLE 1-continued

Exemplary peptide, dipeptide, and polypeptide sequences.

| SEQ ID NO | Name | Sequence |
|---|---|---|
|  |  | YEGIAVFDGKKITVTGTLWNGVKIIDERLITPDGSMSFRV<br>TINSHHHHHH |
| 908 | ATG-5037 | ATGAAACATCACCATCACCATCATGTCTTCACACTCGA<br>CGATTTCGTTGGGGACTGGGAACAGACAGCCGCCTAC<br>AACCTGGACCAAGTCCTTGAACAGGGAGGTGTGTCCA<br>GTTTGCTGCAGAATCTCGCCGTGTCCGTAACTCCGATC<br>ATGAGGATTGTCCGGAGCGGTGAAAATGCCCTGAAGA<br>TCGACATCCATGTCATCATCCCGTATGAAGGTCTGAGC<br>GCCGACCAAATGGCCCAGATCGAAGAGGTGTTTAAGG<br>TGGTGTACCCTGTGGATGATCATCACTTTAAGGTGATC<br>CTGCCCTATGGCACACTGGTAATCGACGGGGTTACGC<br>CGAACAAGCTGAACTATTTCGGACACCCGTATGAAGG<br>CATCGCCGTGTTCGACGGCAAAAAGATCACTACCACA<br>GGGACCCTGTGGAACGGCAACAAAATTATCGACGAGC<br>GCCTGATCACCCCCGACTAA |
| 909 | ATG-5037 | MKHHHHHHVFTLDDFVGDWEQTAAYNLDQVLEQGGV<br>SSLLQNLAVSVTPIMRIVRSGENALKIDIHVIIPYEGLSAD<br>QMAQIEEVFKVVYPVDDHHFKVILPYGTLVIDGVTPNKL<br>NYFGHPYEGIAVFDGKKITTTGTLWNGNKIIDERLITPD |
| 910 | ATG-5038 | ATGAAACATCACCATCACCATCATGTCTTCACACTCGA<br>CGATTTCGTTGGGGACTGGGAACAGACAGCCGCCTAC<br>AACCTGGACCAAGTCCTTGAACAGGGAGGTGTGTCCA<br>GTTTGCTGCAGAATCTCGCCGTGTCCGTAACTCCGATC<br>ATGAGGATTGTCCGGAGCGGTGAAAATGCCCTGAAGA<br>TCGACATCCATGTCATCATCCCGTATGAAGGTCTGAGC<br>GCCGACCAAATGGCCCAGATCGAAGAGGTGTTTAAGG<br>TGGTGTACCCTGTGGATGATCATCACTTTAAGGTGATC<br>CTGCCCTATGGCACACTGGTAATCGACGGGGTTACGC<br>CGAACAAGCTGAACTATTTCGGACGGCCGTATGAAGG<br>CATCGCCGTGTTCGACGGCGAGAAGATCACTACCACA<br>GGGACCCTGTGGAACGGCAACAAAATTATCGACGAGC<br>GCCTGATCACCCCCGACTAA |
| 911 | ATG-5038 | MKHHHHHHVFTLDDFVGDWEQTAAYNLDQVLEQGGV<br>SSLLQNLAVSVTPIMRIVRSGENALKIDIHVIIPYEGLSAD<br>QMAQIEEVFKVVYPVDDHHFKVILPYGTLVIDGVTPNKL<br>NYFGRPYEGIAVFDGEKITTTGTLWNGNKIIDERLITPD |
| 912 | ATG-5039 | ATGAAACATCACCATCACCATCATGTCTTCACACTCGA<br>CGATTTCGTTGGGGACTGGGAACAGACAGCCGCCTAC<br>AACCTGGACCAAGTCCTTGAACAGGGAGGTGTGTCCA<br>GTTTGCTGCAGAATCTCGCCGTGTCCGTAACTCCGATC<br>ATGAGGATTGTCCGGAGCGGTGAAAATGCCCTGAAGA<br>TCGACATCCATGTCATCATCCCGTATGAAGGTCTGAGC<br>GCCGACCAAATGGCCCAGATCGAAGAGGTGTTTAAGG<br>TGGTGTACCCTGTGGATGATCATCACTTTAAGGTGATC<br>CTGCCCTATGGCACACTGGTAATCGACGGGGTTACGC<br>CGAACAAGCTGAACTATTTCGGACGGCCGTATGAAGG<br>CATCGCCGTGTTCGACGGCAAAAAGATCACTACCACA<br>GGGACCCTGCCTAACGGCAACAAAATTATCGACGAGC<br>GCCTGATCACCCCCGACTAA |
| 913 | ATG-5039 | MKHHHHHHVFTLDDFVGDWEQTAAYNLDQVLEQGGV<br>SSLLQNLAVSVTPIMRIVRSGENALKIDIHVIIPYEGLSAD<br>QMAQIEEVFKVVYPVDDHHFKVILPYGTLVIDGVTPNKL<br>NYFGRPYEGIAVFDGKKITTTGTLPNGNKIIDERLITPD |
| 914 | ATG-5040 | ATGAAACATCACCATCACCATCATGTCTTCACACTCGA<br>CGATTTCGTTGGGGACTGGGAACAGACAGCCGCCTAC<br>AACCTGGACCAAGTCCTTGAACAGGGAGGTGTGTCCA<br>GTTTGCTGCAGAATCTCGCCGTGTCCGTAACTCCGATC<br>ATGAGGATTGTCCGGAGCGGTGAAAATGCCCTGAAGA<br>TCGACATCCATGTCATCATCCCGTATGAAGGTCTGAGC<br>GCCGACCAAATGGCCCAGATCGAAGAGGTGTTTAAGG<br>TGGTGTACCCTGTGGATGATCATCACTTTAAGGTGATC<br>CTGCCCTATGGCACACTGGTAATCGACGGGGTTACGC<br>CGAACAAGCTGAACTATTTCGGACGGCCGTATGAAGG<br>CATCGCCGTGTTCGACGGCAAAAAGATCACTACCACA<br>GGGACCCTGTGGAACGGCAACAAAATTATCGACGAGC<br>GCCTGATCGATCCCGACTAA |
| 915 | ATG-5040 | MKHHHHHHVFTLDDFVGDWEQTAAYNLDQVLEQGGV<br>SSLLQNLAVSVTPIMRIVRSGENALKIDIHVIIPYEGLSAD |

TABLE 1-continued

Exemplary peptide, dipeptide, and polypeptide sequences.

| SEQ ID NO | Name | Sequence |
|---|---|---|
| | | QMAQIEEVFKVVYPVDDHHFKVILPYGTLVIDGVTPNKL NYFGRPYEGIAVFDGKKITTTGTLWNGNKIIDERLIDPD |
| 916 | ATG-5041 | ATGAAACATCACCATCACCATCATGTCTTCACACTCGA CGATTTCGTTGGGGACTGGGAACAGACAGCCGCCTAC AACCTGGACCAAGTCCTTGAACAGGGAGGTGTGTCCA GTTTGCTGCAGAATCTCGCCGTGTCCGTAACTCCGATC ATGAGGATTGTCCGGAGCGGTGAAAATGCCCTGAAGA TCGACATCCATGTCATCATCCCGTATGAAGGTCTGAGC GCCGACCAAATGGCCCAGATCGAAGAGGTGTTTAAGG TGGTGTACCCTGTGGATGATCATCACTTTAAGGTGATC CTGCCCTATGGCACACTGGTAATCGACGGGGTTACGC CGAACAAGCTGAACTATTTCGGACGGCCGTATGAAGG CATCGCCGTGTTCGACGGCAAAAAGATCACTACCACA GGGACCCTGTGGAACGGCAACAAAATTATCGACGAGC GCCTGATCACCGATGACTAA |
| 917 | ATG-5041 | MKHHHHHHVFTLDDFVGDWEQTAAYNLDQVLEQGGV SSLLQNLAVSVTPIMRIVRSGENALKIDIHVIIPYEGLSAD QMAQIEEVFKVVYPVDDHHFKVILPYGTLVIDGVTPNKL NYFGRPYEGIAVFDGKKITTTGTLWNGNKIIDERLITDD |
| 918 | ATG-5135 | ATGAAACATCACCATCACCATCATGTCTTCACACTCGA CGATTTCGTTGGGGACTGGGAACAGACAGCCGCCTAC AACCTGGACCAAGTCCTTGAACAGGGAGGTGTGTCCA GTTTGCTGCAGAATCTCGCCGTGTCCGTAACTCCGATC ATGAGGATTGTCCGGAGCGGTGAAAATGCCCTGAAGA TCGACATCCATGTCATCATCCCGTATGAAGGTCTGAGC GCCGACCAAATGGCCCAGATCGAAGAGGTGTTTAAGG TGGTGTACCCTGTGGATGATCATCACTTTAAGGTGATC CTGCCCTATGGCACACTGGTAATCGACGGGGTTACGC CGAACAAGCTGAACTATTTCGGACACCCGTATGAAGG CATCGCCGTGTTCGACGGCGAGAAGATCACTACCACA GGGACCCTGTGGAACGGCAACAAAATTATCGACGAGC GCCTGATCACCCCCGACTAA |
| 919 | ATG-5135 | MKHHHHHHVFTLDDFVGDWEQTAAYNLDQVLEQGGV SSLLQNLAVSVTPIMRIVRSGENALKIDIHVIIPYEGLSAD QMAQIEEVFKVVYPVDDHHFKVILPYGTLVIDGVTPNKL NYFGHPYEGIAVFDGEKITTTGTLWNGNKIIDERLITPD |
| 920 | ATG-5146 | ATGAAACATCACCATCACCATCATGTCTTCACACTCGA CGATTTCGTTGGGGACTGGGAACAGACAGCCGCCTAC AACCTGGACCAAGTCCTTGAACAGGGAGGTGTGTCCA GTTTGCTGCAGAATCTCGCCGTGTCCGTAACTCCGATC ATGAGGATTGTCCGGAGCGGTGAAAATGCCCTGAAGA TCGACATCCATGTCATCATCCCGTATGAAGGTCTGAGC GCCGACCAAATGGCCCAGATCGAAGAGGTGTTTAAGG TGGTGTACCCTGTGGATGATCATCACTTTAAGGTGATC CTGCCCTATGGCACACTGGTAATCGACGGGGTTACGC CGAACAAGCTGAACTATTTCGGACACCCGTATGAAGG CATCGCCGTGTTCGACGGCGAGAAGATCACTACCACA GGGACCCTGTGGAACGGCAACAAAATTATCGACGAGC GCCTGATCGATCCCGACTAA |
| 921 | ATG-5146 | MKHHHHHHVFTLDDFVGDWEQTAAYNLDQVLEQGGV SSLLQNLAVSVTPIMRIVRSGENALKIDIHVIIPYEGLSAD QMAQIEEVFKVVYPVDDHHFKVILPYGTLVIDGVTPNKL NYFGHPYEGIAVFDGEKITTTGTLWNGNKIIDERLIDPD |
| 922 | ATG-5158 | ATGAAACATCACCATCACCATCATGTCTTCACACTCGA CGATTTCGTTGGGGACTGGGAACAGACAGCCGCCTAC AACCTGGACCAAGTCCTTGAACAGGGAGGTGTGTCCA GTTTGCTGCAGAATCTCGCCGTGTCCGTAACTCCGATC ATGAGGATTGTCCGGAGCGGTGAAAATGCCCTGAAGA TCGACATCCATGTCATCATCCCGTATGAAGGTCTGAGC GCCGACCAAATGGCCCAGATCGAAGAGGTGTTTAAGG TGGTGTACCCTGTGGATGATCATCACTTTAAGGTGATC CTGCCCTATGGCACACTGGTAATCGACGGGGTTACGC CGAACAAGCTGAACTATTTCGGACACCCGTATGAAGG CATCGCCGTGTTCGACGGCGAGAAGATCACTACCACA GGGACCCTGTGGAACGGCAACAAAATTATCGACGAGC GCCTGATCGATGATGACTAA |
| 923 | ATG-5158 | MKHHHHHHVFTLDDFVGDWEQTAAYNLDQVLEQGGV SSLLQNLAVSVTPIMRIVRSGENALKIDIHVIIPYEGLSAD |

TABLE 1-continued

Exemplary peptide, dipeptide, and polypeptide sequences.

| SEQ ID NO | Name | Sequence |
|---|---|---|
| | | QMAQIEEVFKVVYPVDDHHFKVILPYGTLVIDGVTPNKL NYFGHPYEGIAVFDGEKITTTGTLWNGNKIIDERLIDDD |
| 924 | ATG-5260 | ATGAAACATCACCATCACCATCATGATTTCACACTCG ACGATTTCGTTGGGGACTGGGAACAGACAGCCGCCTA CAACCTGGACCAAGTCCTTGAACAGGGAGGTGTGTCC AGTTTGCTGCAGAATCTCGCCGTGTCCGTAACTCCGAT CATGAGGATTGTCCGGAGCGGTGAAAATGCCCTGAAG ATCGACATCCATGTCATCATCCCGTATGAAGGTCTGA GCGCCGACCAAATGGCCCAGATCGAAGAGGTGTTTAA GGTGGTGTACCCTGTGGATGATCATCACTTTAAGGTG ATCCTGCCCATCGGCACACTGGTAATCGACGGGGTTA CGCCGAACAAGCTGAACTATTTCGGACACCCGTATGA AGGCATCGCCGTGTTCGACGGCGAGAAGATCACTACC ACAGGGACCCTGTGGAACGGCAACAAAATTATCGACG AGCGCCTGATCGATCCCGACTAA |
| 925 | ATG-5260 | MKHHHHHHDFTLDDFVGDWEQTAAYNLDQVLEQGGV SSLLQNLAVSVTPIMRIVRSGENALKIDIHVIIPYEGLSAD QMAQIEEVFKVVYPVDDHHFKVILPIGTLVIDGVTPNKL NYFGHPYEGIAVFDGEKITTTGTLWNGNKIIDERLIDPD |
| 926 | ATG-5266 | ATGAAACATCACCATCACCATCATGTCTTCACACTCGA CGATTTCGTTGGGGACTGGGAACAGACAGCCGCCTAC AACCTGGACCAAGTCCTTGAACAGGGAGGTGTGTCCA GTTTGCTGCAGAATCTCGCCGTGTCCGTAACTCCGATC ATGAGGATTGTCCGGAGCGGTGAAAATGCCCTGAAGA TCGACATCCATGTCATCATCCCGTATGAAGGTCTGAGC GCCGACCAAATGGCCCAGATCGAAGAGGTGTTTAAGG TGGTGTACCCTGTGGATGATCATCACTTTAAGGTGATC CTGCCCATCGGCACACTGGTAATCGACGGGGAGACGC CGAACAAGCTGAACTATTTCGGACACCCGTATGAAGG CATCGCCGTGTTCGACGGCGAGAAGATCACTACCACA GGGACCCTGTGGAACGGCAACAAAATTATCGACGAGC GCCTGATCGATCCCGACTAA |
| 927 | ATG-5266 | MKHHHHHHVFTLDDFVGDWEQTAAYNLDQVLEQGGV SSLLQNLAVSVTPIMRIVRSGENALKIDIHVIIPYEGLSAD QMAQIEEVFKVVYPVDDHHFKVILPIGTLVIDGETPNKL NYFGHPYEGIAVFDGEKITTTGTLWNGNKIIDERLIDPD |
| 928 | ATG-5267 | ATGAAACATCACCATCACCATCATGTCTTCACACTCGA CGATTTCGTTGGGGACTGGGAACAGACAGCCGCCTAC AACCTGGACCAAGTCCTTGAACAGGGAGGTGTGTCCA GTTTGCTGCAGAATCTCGCCGTGTCCGTAACTCCGATC ATGAGGATTGTCCGGAGCGGTGAAAATGCCCTGAAGA TCGACATCCATGTCATCATCCCGTATGAAGGTCTGAGC GCCGACCAAATGGCCCAGATCGAAGAGGTGTTTAAGG TGGTGTACCCTGTGGATGATCATCACTTTAAGGTGATC CTGCCCATCGGCACACTGGTAATCGACGGGGTTACGC CGAACAAGCTGAACTATTTCGGACACCCGTATGAAGG CATCGCCGATTTCGACGGCGAGAAGATCACTACCACA GGGACCCTGTGGAACGGCAACAAAATTATCGACGAGC GCCTGATCGATCCCGACTAA |
| 929 | ATG-5267 | MKHHHHHHVFTLDDFVGDWEQTAAYNLDQVLEQGGV SSLLQNLAVSVTPIMRIVRSGENALKIDIHVIIPYEGLSAD QMAQIEEVFKVVYPVDDHHFKVILPIGTLVIDGVTPNKL NYFGHPYEGIADFDGEKITTTGTLWNGNKIIDERLIDPD |
| 930 | ATG-5278 | ATGAAACATCACCATCACCATCATGTCTTCACACTCGA CGATTTCGTTGGGGACTGGGAACAGACAGCCGCCTAC AACCTGGACCAAGTCCTTGAACAGGGAGGTGTGTCCA GTTTGCTGCAGAATCTCGCCGTGTCCGTAACTCCGATC ATGAGGATTGTCCGGAGCGGTGAAAATGCCCTGAAGA TCGACATCCATGTCATCATCCCGTATGAAGGTCTGAGC GCCGACCAAATGGCCCAGATCGAAGAGGTGTTTAAGG TGGTGTACCCTGTGGATGATCATCACTTTAAGGTGATC CTGCCCATCGGCACACTGGTAATCGACGGGGAGACGC CGAACAAGCTGAACTATTTCGGACACCCGTATGAAGG CATCGCCGATTTCGACGGCGAGAAGATCACTACCACA GGGACCCTGTGGAACGGCAACAAAATTATCGACGAGC GCCTGATCGATCCCGACTAA |

TABLE 1-continued

Exemplary peptide, dipeptide, and polypeptide sequences.

| SEQ ID NO | Name | Sequence |
|---|---|---|
| 931 | ATG-5278 | MKHHHHHHVFTLDDFVGDWEQTAAYNLDQVLEQGGV SSLLQNLAVSVTPIMRIVRSGENALKIDIHVIIPYEGLSAD QMAQIEEVFKVVYPVDDHHFKVILPIGTLVIDGETPNKL NYFGHPYEGIADFDGEKITTTGTLWNGNKIIDERLIDPD |
| 932 | ATG-4794 | atgaaacatcaccatcaccatcatgtcttcacactcgacgatttcgttgggactgggaaca gacagccgcctacaacctggaccaagtccttgaacaggagggtgtgtccagtttgctgca gaatctcgccgtgtccgtaactccgatcatgaggattgtccggagcggtgaaaatgccct gaagatcgacatccatgtcatcatcccgtatgaaggtctgagcgccgaccaaatggccca gatcgaagaggtgtttaaggtggtgtaccctgtggatgatcatcactttaaggtgatcctgc cctatggcacactggtaatcgac |
| 933 | ATG-4794 | MKHHHHHHVFTLDDFVGDWEQTAAYNLDQVLEQGGV SSLLQNLAVSVTPIMRIVRSGENALKIDIHVIIPYEGLSAD QMAQIEEVFKVVYPVDDHHFKVILPYGTLVID |

TABLE 9

Exemplary peptide sequences.

| Pep ID | SEQ ID NO. | Sequence |
|---|---|---|
| 86 | 824 | VSGWRLFKKIS |
| 229 | 825 | VSGWRLFKKI |
| 289 | 826 | VSVSGWRLFKKIS |
| 521 | 827 | GKMLFRVTINSWK |
| 543 | 366 | WNGNKIIDERLITPD |
| 544 | 367 | KKITTTGTLWNGR |
| 545 | 368 | RPYEGIAVFDGK |
| 591 | 369 | GKMLFRVTIWKVSVSGWRLFKKIS |
| 592 | 370 | GKMLFRVTIWKVSVSGWRLFKKIS |
| 593 | 371 | GSMKFRVTINSWKVSVSGWRLFKKIS |
| 594 | 372 | GSMKFRVTINSWKVSGWRLFKKIS |
| 595 | 373 | GSMKFRVTINSWKNVTGYRLFKKISN |
| 596 | 374 | GSMKFRVTINSWKVTGYRLFEKIS |
| 597 | 375 | GSMKFRVTIWKVSVSGWRLFKKIS |
| 598 | 376 | GSMKFRVTIWKVSGWRLFKKIS |
| 599 | 377 | GRMLFRVTINSWKVSVSGWRLFKKIS |
| 600 | 378 | GRMLFRVTINSWKVSGWRLFKKIS |
| 601 | 379 | GRMLFRVTIWKVSVSGWRLFKKIS |
| 602 | 380 | GRMLFRVTIWKVSGWRLFKKIS |
| 603 | 381 | GSMLFRVTINSVSVSGWRLFKKIS |
| 604 | 382 | GSMLFKVTINSVSGWRLFKKIS |
| 605 | 383 | GSMLFQVTINSVSGWRLFKKIS |
| 606 | 384 | GSMLFEVTINSVSGWRLFKKIS |
| 607 | 385 | GSMLFNVTINSVSGWRLFKKIS |
| 608 | 386 | GRPYEGIAVFDGKKITTTGTL |
| 609 | 387 | GSMKFRVTINSWKVTGYRLFEKES |
| 610 | 388 | GSMKFRVTINSWKVEGYRLFEKIS |
| 611 | 389 | KKITTTGTLWNGNKIIDERLITPD |
| 612 | 390 | WNGNKIIDERLITPDGSMLFRVTINS |
| 671 | 391 | GKMLFRVTIQKWK |
| 668 | 392 | GKMLFRVTIGKWK |
| 727 | 393 | GKMLFRVTIGRWK |
| 669 | 394 | GKMLFRVTIGNWK |
| 674 | 395 | GKMLFRVTIQNWK |
| 702 | 396 | GKMLFRVTIDKWK |
| 703 | 397 | GKMLFRVTIEKWK |
| 705 | 810 | EKMLFRVTIESWK |
| 724 | 811 | EKLLFRVTIESWK |
| 725 | 812 | EKLLFRVTIESYK |
| 730 | 398 | GKMLFRVTIERWK |
| 731 | 399 | GKMLFRVTIDRWK |
| 738 | 400 | DKMLFRVTIQKWK |
| 739 | 401 | DKMLFRVTIGKWK |
| 848 | 402 | DKMLFRVTIGRWK |
| 740 | 403 | DKMLFRVTIGNWK |
| 741 | 404 | DKMLFRVTIQNWK |
| 732 | 405 | DKMLFRVTIDKWK |
| 742 | 406 | DKMLFRVTIEKWK |

TABLE 9-continued

Exemplary peptide sequences.

| Pep ID | SEQ ID NO. | Sequence |
|---|---|---|
| 735 | 407 | DKMLFRVTIERWK |
| 733 | 408 | DKMLFRVTIDRWK |
| 759 | 816 | DKLLFTVTIEKYK |
| 798 | 409 | RPYEGIAVFDGKKITVTGTLWNGNKIIDERLITPD |
| 849 | 410 | EKMLFRVTIQKWK |
| 708 | 411 | EKMLFRVTIGKWK |
| 709 | 412 | EKMLFRVTIGRWK |
| 775 | 413 | DKMLFTVTIQKVSGWRLFKKIS |
| 788 | 414 | DKLLFTVTIEKVSGWRLFKKIS |
| 789 | 415 | DKLLFTVTIEKWKVSGWRLFKKIS |
| 790 | 416 | DKLLFTVTIEKYKVSGWRLFKKIS |
| 792 | 417 | DKLLFTVTIEKYKVSVSGWRLFKKIS |
| 795 | 418 | KKMLFRVTIQKVSGWRLFKKIS |
| 797 | 419 | KKMLFRVTIQKWKVSGWRLFKKIS |
| 796 | 420 | KKMLFRVTIQKWKVSGWRLFKKIS |
| 804 | 421 | DKLLFTVTIGKVSGWRLFKKIS |
| 805 | 422 | DKLLFTVTIGKYKVSGWRLFKKIS |
| 806 | 423 | DKLLFTVTIGKYKVSVSGWRLFKKIS |
| 807 | 424 | DKLLFTVTIGKWKVSVSGWRLFKKIS |
| 808 | 425 | DKLLFTVTIQKVSGWRLFKKIS |
| 813 | 426 | KKMLFTVTIQKVSGWRLFKKIS |
| 816 | 427 | KKLLFRVTIQKVSGWRLFKKIS |
| 825 | 428 | DKLLFTVTIEKVSGWRLFKKI |
| 826 | 429 | DKLLFTVTIEKYKVSVSGWRLFKKI |
| 827 | 430 | DRLLFTVTIERVSGWRLFKKIS |
| 831 | 431 | EKLLFTVTIEKVSGWRLFKKIS |
| 832 | 432 | KKLLFTVTIGKVSGWRLFKKIS |
| 833 | 433 | GSMRFRVTINSWRVTGYRLFERES |
| 834 | 434 | GSMKFRVTINSVTGYRLFEKES |
| 844 | 435 | KKITTTGTLWNGNKIID |
| 845 | 436 | ERLITPDGSMLFRVTINSVSGWRLFKKIS |
| 846 | 437 | GRPYEGIAVDFGKKITTTGTLWNGNKIIDER-LITPDGSML FRVTINSVSGWRLFKKIS |
| 847 | 438 | GVTPNKLNYFGRPYEGIAVDFGKKITTTGTLWNG-NKIID ERLITPDGSMLFRVTINSVSGWRLFKKIS |
| 850 | 439 | EKMLFRVTIGNWK |
| 851 | 440 | EKMLFRVTIQNWK |
| 706 | 441 | EKMLFRVTIDKWK |
| 707 | 442 | EKMLFRVTIEKWK |
| 737 | 443 | EKMLFRVTIERWK |
| 736 | 444 | EKMLFRVTIDRWK |
| 760 | 445 | KKMLFRVTIQKWK |
| 852 | 446 | KKMLFRVTIGKWK |
| 853 | 447 | KKMLFRVTIGRWK |
| 854 | 448 | KKMLFRVTIGNWK |
| 855 | 449 | KKMLFRVTIQNWK |
| 856 | 450 | KKMLFRVTIDKWK |
| 857 | 451 | KKMLFRVTIEKWK |
| 858 | 452 | KKMLFRVTIERWK |
| 859 | 453 | KKMLFRVTIDRWK |
| 860 | 454 | RKMLFRVTIQKWK |
| 861 | 455 | RKMLFRVTIGKWK |
| 862 | 456 | RKMLFRVTIGRWK |
| 863 | 457 | RKMLFRVTIGNWK |
| 864 | 458 | RKMLFRVTIQNWK |
| 865 | 459 | RKMLFRVTIDKWK |
| 866 | 460 | RKMLFRVTIEKWK |
| 867 | 461 | RKMLFRVTIERWK |
| 868 | 462 | RKMLFRVTIDRWK |
| 656 | 463 | EQMLFRVTINSWK |
| 869 | 464 | SRMLFRVTINSWK |
| 533 | 465 | GEMLFRVTINSWK |
| 690 | 466 | GKMKFRVTINSWK |
| 678 | 467 | GKMLFRVKINSWK |
| 679 | 468 | GKMLFRVRINSWK |
| 681 | 469 | GKMLFRVDINSWK |
| 663 | 470 | GKMLFRVTIDSWK |
| 743 | 471 | GKMLFRVTINKWK |
| 714 | 472 | EKMLFKVTIQKWK |
| 870 | 473 | EKMLFTVTIQKWK |
| 871 | 474 | EKMLFKVTIDKWK |
| 872 | 475 | EKMLFTVTIDKWK |
| 873 | 476 | EKMLFKVTIGRWK |
| 744 | 477 | DKMLFKVTIQKWK |
| 745 | 478 | DKMLFTVTIQKWK |

TABLE 9-continued

Exemplary peptide sequences.

| Pep ID | SEQ ID NO. | Sequence |
|---|---|---|
| 874 | 479 | DKMLFKVTIDKWK |
| 875 | 480 | DKMLFTVTIDKWK |
| 876 | 481 | GKMLFKVTIEKWK |
| 877 | 482 | GKMLFTVTIEKWK |
| 748 | 483 | DKMLFKVTIGKWK |
| 749 | 484 | DKMLFTVTIGKWK |
| 878 | 485 | DKMLFKVTIGNWK |
| 879 | 486 | DKMLFKVTIQNWK |
| 781 | 487 | GKMLFKVTINKWK |
| 782 | 488 | GKMLFTVTINKWK |
| 752 | 489 | DKMLFKVTIEKWK |
| 753 | 490 | DKMLFTVTIEKWK |
| 750 | 491 | DKLLFKVTIGKWK |
| 786 | 492 | DKMLFTVTINKWK |
| 756 | 493 | DKLLFTVTIQKWK |
| 757 | 494 | DKLLFTVTIQKYK |
| 758 | 495 | DKLLFTVTIEKWK |
| 759 | 496 | DKLLFTVTIEKYK |
| 793 | 497 | DKLLFTVTIGKWK |
| 794 | 498 | DKLLFTVTIGKYK |
| 799 | 499 | DKLLFTVTINKWK |
| 800 | 500 | DKLLFTVTINKYK |
| 780 | 501 | GKMLFRVTINS |
| 765 | 502 | DKMLFTVTIQK |
| 779 | 503 | DKMLFKVTIQK |
| 820 | 504 | DKLLFTVTIGK |
| 819 | 505 | DKMLFTVTIGK |
| 822 | 506 | DKMLFTVTIEK |
| 821 | 507 | DKLLFTVTIEK |
| 627 | 508 | *DKMLFRVTINSWK |
| 628 | 509 | *EKMLFRVTINSWK |
| 629 | 510 | *RKMLFRVTINSWK |
| 630 | 511 | *KKMLFRVTINSWK |
| 631 | 512 | *HKMLFRVTINSWK |
| 632 | 513 | *GLMLFRVTINSWK |
| 633 | 514 | *GQMLFRVTINSWK |
| 634 | 515 | *GTMLFRVTINSWK |
| 635 | 516 | *GKLLFRVTINSWK |

TABLE 9-continued

Exemplary peptide sequences.

| Pep ID | SEQ ID NO. | Sequence |
|---|---|---|
| 636 | 517 | *GKMLFKVTINSWK |
| 637 | 518 | *GKMLFRVTIQSWK |
| 638 | 519 | *GKMLFRVTIDSWK |
| 639 | 520 | *GKMLFRVTIGSWK |
| 640 | 521 | *GKMLFRVTINTWK |
| 641 | 522 | *GKMLFRVTINNWK |
| 642 | 523 | *GKMLFRVTINQWK |
| 643 | 524 | *GKMLFRVTINPWK |
| 644 | 525 | *GKMLFRVTINKWK |
| 645 | 526 | *GKMLFRVTINSWQ |
| 646 | 527 | *GKMLFRVTINSWN |
| 647 | 528 | *GKMLFRVTINSWT |
| 648 | 529 | *GKMLFRVTINSWH |
| 649 | 530 | *GKMLFRVTINSWP |
| 650 | 53 | *GKMLFRVTINSWR |
| 677 | 532 | GKMKFRVTIDSWK |
| 680 | 533 | GKMLFRVEINSWK |
| 682 | 534 | GKMLFRVQINSWK |
| 683 | 535 | GKMKFRVKINSWK |
| 684 | 536 | GKMKFRVRINSWK |
| 685 | 537 | GKMKFRVEINSWK |
| 686 | 538 | GKMKFRVDINSWK |
| 687 | 539 | GKMKFRVQINSWK |
| 688 | 540 | GKMKFRVNINSWK |
| 689 | 541 | GKMKFRVSINSWK |
| 613 | 542 | GKMLFRVNINSWK |
| 614 | 543 | GKMLFRVSINSWK |
| 615 | 544 | GKMLFRVWINSWK |
| 616 | 545 | GKMSFRVTINSWK |
| 617 | 546 | GKMWFRVTINSWK |
| 618 | 547 | GKMNFRVTINSWK |
| 619 | 548 | GSMLFRVTINSYK |
| 620 | 549 | GKMLFRVTINSYK |
| 621 | 550 | GKMLFRVTIKSWK |
| 622 | 55 | GKMLFRVTIESWK |
| 716 | 552 | GKMKFRVTIQSWK |
| 717 | 553 | GKMKFRVTIESWK |

TABLE 9-continued

Exemplary peptide sequences.

| Pep ID | SEQ ID NO. | Sequence |
|---|---|---|
| 718 | 554 | GKMKFRVTIKSWK |
| 719 | 555 | GKMKFRVTIRSWK |
| 651 | 556 | RLMLFRVTINSWK |
| 652 | 557 | RQMLFRVTINSWK |
| 653 | 558 | KLMLFRVTINSWK |
| 654 | 559 | KQMLFRVTINSWK |
| 655 | 560 | ELMLFRVTINSWK |
| 657 | 561 | DLMLFRVTINSWK |
| 658 | 562 | DQMLFRVTINSWK |
| 659 | 563 | DKMLFRVTINSWK |
| 660 | 564 | EKMLFRVTINSWK |
| 661 | 565 | RKMLFRVTINSWK |
| 662 | 566 | KKMLFRVTINSWK |
| 665 | 567 | GKMLFRVTIGSWK |
| 667 | 568 | GKMLFRVTINKWK |
| 670 | 569 | GKMLFRVTISKWK |
| 671 | 570 | GKMLFRVTIQKWK |
| 672 | 571 | GKMLFRVTITKWK |
| 673 | 572 | GKMLFRVTIKKWK |
| 675 | 573 | GKMLFKVTINSWK |
| 676 | 574 | RLMLFRVTIGKWK |
| 701 | 575 | GKMLFRVTINRWK |
| 710 | 576 | EKMLFTVTIGKWK |
| 711 | 577 | EKLLFTVTIGKWK |
| 712 | 578 | EKMLFTVTIGRWK |
| 720 | 579 | EKMLFTVTIEKWK |
| 722 | 580 | DKMLFRVTIESWK |
| 726 | 58 | EKLLFRVTIGKYK |
| 746 | 582 | DKLLFKVTIQKWK |
| 747 | 583 | DKLLFKVTIQKYK |
| 751 | 584 | DKLLFKVTIGKYK |
| 754 | 585 | DKLLFKVTIEKWK |
| 755 | 586 | DKLLFKVTIEKYK |
| 761 | 587 | KKLLFRVTIQKWK |
| 762 | 588 | DRMLFRVTIQRWR |
| 766 | 589 | ERMLFRVTIGRWR |
| 768 | 590 | GRMLFRVTINRWR |
| 770 | 591 | DRMLFRVTIERWR |
| 783 | 592 | DKMLFKVTIQKYK |
| 784 | 593 | DKMLFRVTINKWK |
| 785 | 594 | DKMLFKVTIEKYK |
| 787 | 595 | DKMLFKVTINKWK |
| 693 | 900 | GRMLFRVTINSWR |
| 691 | 901 | VSGWRLFRRIS |
| 895 | 902 | GRLLFVVIERYR |
| 937 | 903 | VSGWRLFRRISC |
| 938 | 904 | GRMLFRVTINSWRC |
| 939 | 905 | GRLLFTVTIERYRC |
| 840 | 906 | GKLLFVVIEKYK |
| 900 | 907 | GKLLFVTIEKVSGWRLFKKIS |

*Terminus unblocked

TABLE 10

Exemplary luciferase base sequences

| Pep ID | SEQ ID NO. | Sequence |
|---|---|---|
| LgTrip 3546 - WT strand 9 - HIBIT | 788 | MVFTLDDFVGDWEQTAAYNLDQVLEQGGVSSLLQNLAVS VTPIMRIVRSGENALKIDIHVIIPYEGLSADQMAQIEEVFKV VYPVDDHHFKVILPYGTLVIDGVTPNKLNYFGRPYEGIAV FDGKKITTTGTLWNGNKIIDERLITPDGSMLFRVTINSVSG WRLFKKIS |
| LgTrip 3546 - WT strand 9 - SmBIT | 789 | MVFTLDDFVGDWEQTAAYNLDQVLEQGGVSSLLQNLAVS VTPIMRIVRSGENALKIDIHVIIPYEGLSADQMAQIEEVFKV VYPVDDHHFKVILPYGTLVIDGVTPNKLNYFGRPYEGIAV FDGKKITTTGTLWNGNKIIDERLITPDGSMLFRVTINSVTG YRLFEEIL |

TABLE 10-continued

Exemplary luciferase base sequences

| Pep ID | SEQ ID NO. | Sequence |
|---|---|---|
| LgTrip 3546 (1-5) | 790 | MVFTLDDFVGDWEQTAAYNLDQVLEQGGVSSLLQNLAVS VTPIMRIVRSGENALKIDIHVIIPYEGLSADQMAQIEEVFKV VYPVDDHHFKVILPYGTLVID |
| LgTrip 3546 (1-6) | 791 | MVFTLDDFVGDWEQTAAYNLDQVLEQGGVSSLLQNLAVS VTPIMRIVRSGENALKIDIHVIIPYEGLSADQMAQIEEVFKV VYPVDDHHFKVILPYGTLVIDGVTPNKLNYFGRPYEGIAV FDG |
| LgTrip 3546 (1-7) | 792 | MVFTLDDFVGDWEQTAAYNLDQVLEQGGVSSLLQNLAVS VTPIMRIVRSGENALKIDIHVIIPYEGLSADQMAQIEEVFKV VYPVDDHHFKVILPYGTLVIDGVTPNKLNYFGRPYEGIAV FDGKKITTTGTL |
| LgTrip 3546 (1-8) | 793 | MVFTLDDFVGDWEQTAAYNLDQVLEQGGVSSLLQNLAVS VTPIMRIVRSGENALKIDIHVIIPYEGLSADQMAQIEEVFKV VYPVDDHHFKVILPYGTLVIDGVTPNKLNYFGRPYEGIAV FDGKKITTTGTLWNGNKIIDERLITPD |
| LgTrip 3546 (strands 6-8) - WT strand 9 - HIBIT | 794 | GVTPNKLNYFGRPYEGIAVFDGKKITTTGTLWNGNKIID ERLITPDGSMLFRVTINSVSGWRLFKKIS |
| LgTrip 3546 (strands 7-8) - WT strand 9 - HIBIT | 795 | KKITTTGTLWNGNKIIDERLITPDGSMLFRVTINSVSGWR LFKKIS |
| LgTrip 3546 (strand 8) - WT strand 9 - HIBIT | 796 | WNGNKIIDERLITPDGSMLFRVTINSVSGWRLFKKIS |
| WT strand 9 - HIBIT | 797 | GSMLFRVTINSVSGWRLFKKIS |
| LgTrip 3546 (strands 6-8) - WT strand 9 - SmBIT | 798 | GVTPNKLNYFGRPYEGIAVFDGKKITTTGTLWNGNKIID ERLITPDGSMLFRVTINSVTGYRLFEEIL |
| LgTrip 3546 (strands 7-8) - WT strand 9 - SmBIT | 799 | KKITTTGTLWNGNKIIDERLITPDGSMLFRVTINSVTGYRL FEEIL |
| LgTrip 3546 (strand 8) - WT strand 9 - SmBIT | 800 | WNGNKIIDERLITPDGSMLFRVTINSVTGYRLFEEIL |
| WT strand 9 - SmBIT | 801 | GSMLFRVTINSVTGYRLFEEIL |
| β6-like | 817 | GVTPNKLNYFGRPYEGIAVEDG |
| β7-like | 818 | KKITTTGTL |
| β8-like | 819 | WNGNKIIDERLITPD |

TABLE 11

Exemplary polypeptides

| Name | Polypeptide construct description |
|---|---|
| ATG-2623 | LgBiT-6His |
| ATG-3745 | HiBiT-8His-LgTrip |
| ATG-3746 | 6His-HiBiT-4GS-LgTrip |
| ATG-4632 | HiBiT-4GS-LgTrip-6His |
| ATG-4808 | VS-HiBiT-0GS-LgTrip |
| ATG-4809 | VS-HiBiT-4GS-LgTrip |
| ATG-4810 | VS-HiBiT-8GS-LgTrip |
| ATG-4811 | VS-HiBiT-12GS-LgTrip |
| ATG-4812 | VS-HiBiT-16GS-LgTrip |
| ATG-4813 | VS-HiBiT-20GS-LgTrip |
| ATG-4814 | HiBiT-20GS-LgTrip |
| ATG-4815 | LgTrip-0GS-VS-HiBiT |
| ATG-4816 | LgTrip-4GS-VS-HiBiT |
| ATG-4817 | LgTrip-8GS-VS-HiBiT |
| ATG-4818 | LgTrip-8GS-HiBiT |
| ATG-4819 | VS-HiBIT-0GS-LgTrip-6His |
| ATG-4820 | VS-HiBiT-4GS-LgTrip-6His |
| ATG-4821 | VS-HiBiT-8GS-LgTrip-6His |
| ATG-4822 | VS-HiBiT-12GS-LgTrip-6His |
| ATG-4823 | VS-HiBiT-16GS-LgTrip-6His |
| ATG-4824 | HiBiT-20GS-LgTrip-6His |
| ATG-4825 | VS-HiBiT-20GS-LgTrip-6His |
| ATG-4826 | 6His-LgTrip-0GS-VS-HiBiT |
| ATG-4827 | 6His-LgTrip-4GS-VS-HiBiT |
| ATG-4828 | 6His-LgTrip-8GS-HiBiT |
| ATG-4829 | 6His-LgTrip-8GS-VS-HiBiT |

Mutations on 5333
ATG-5538 (I41T) Nucleotide
(SEQ ID NO: 934)
GTCTTCACACTCGAAGATTTCGTTGGGGACTGGAAACAGACAGCCGCCTA
CAACCTGGACCAAGTCCTTGAACAGGGAGGTGTGTCCAGTTTGCTGCAGA
ATCTCGCCGTGTCCGTAACTCCGACCCAAAGGATGGTCCGGAGCGGTGAA
AATGCCCTGAAGATCGACATCCATGTCATCATCCCGTATGAAGGTCTGAG
CGCCGACCAAATGGCCCAGATCGAAGAGGTGTTTAAGGTGGTGTACCCTG
TGGATGATCATCACTTTAAGGTGATCCTGCCCTATGGCACACTGGTAATC
GACGGGGTTACGCCGAACATGCTGAACTATTTCGGACGGCCGTATGAAGG
CATCGCCGTGTTCGACGGCAAAAAGATCACTGTAACAGGGACCCTGTGGA
ACGGCGTCAAAATTATCGACGAGCGCCTGATCACCCCCGACGGCTCCATG
TCCTTCCGAGTAACCATCAACAGC ATG-5538 (I41T) Amino Acid
(SEQ ID NO: 935)
VFTLEDFVGDWKQTAAYNLDQVLEQGGVSSLLQNLAVSVTPTQRMVRSGE
NALKIDIHVIIPYEGLSADQMAQIEEVFKVVYPVDDHHFKVILPYGTLVI
DGVTPNMLNYFGRPYEGIAVFDGKKITVTGTLWNGVKIIDERLITPDGSM
SFRVTINS ATG-5339 (K11N) Nucleotide
(SEQ ID NO: 936)
GTCTTCACACTCGAAGATTTCGTTGGGGACTGGAACCAGACAGCCGCCTA
CAACCTGGACCAAGTCCTTGAACAGGGAGGTGTGTCCAGTTTGCTGCAGA
ATCTCGCCGTGTCCGTAACTCCGATCCAAAGGATGGTCCGGAGCGGTGAA
AATGCCCTGAAGATCGACATCCATGTCATCATCCCGTATGAAGGTCTGAG
CGCCGACCAAATGGCCCAGATCGAAGAGGTGTTTAAGGTGGTGTACCCTG
TGGATGATCATCACTTTAAGGTGATCCTGCCCTATGGCACACTGGTAATC
GACGGGGTTACGCCGAACATGCTGAACTATTTCGGACGGCCGTATGAAGG
CATCGCCGTGTTCGACGGCAAAAAGATCACTGTAACAGGGACCCTGTGGA
ACGGCGTCAAAATTATCGACGAGCGCCTGATCACCCCCGACGGCTCCATG
TCCTTCCGAGTAACCATCAACAGC ATG-5339 (K11N) Amino Acid
(SEQ ID NO: 937)
VFTLEDFVGDWNQTAAYNLDQVLEQGGVSSLLQNLAVSVTPIQRMVRSGE
NALKIDIHVIIPYEGLSADQMAQIEEVFKVVYPVDDHHFKVILPYGTLVI
DGVTPNMLNYFGRPYEGIAVFDGKKITVTGTLWNGVKIIDERLITPDGSM
SFRVTINS ATG-5340 (R152Q) Nucleotide
(SEQ ID NO: 938)
GTCTTCACACTCGAAGATTTCGTTGGGGACTGGAAACAGACAGCCGCCTA
CAACCTGGACCAAGTCCTTGAACAGGGAGGTGTGTCCAGTTTGCTGCAGA
ATCTCGCCGTGTCCGTAACTCCGATCCAAAGGATGGTCCGGAGCGGTGAA
AATGCCCTGAAGATCGACATCCATGTCATCATCCCGTATGAAGGTCTGAG
CGCCGACCAAATGGCCCAGATCGAAGAGGTGTTTAAGGTGGTGTACCCTG
TGGATGATCATCACTTTAAGGTGATCCTGCCCTATGGCACACTGGTAATC
GACGGGGTTACGCCGAACATGCTGAACTATTTCGGACGGCCGTATGAAGG
CATCGCCGTGTTCGACGGCAAAAAGATCACTGTAACAGGGACCCTGTGGA
ACGGCGTCAAAATTATCGACGAGCGCCTGATCACCCCCGACGGCTCCATG
TCCTTCCAAGTAACCATCAACAGC ATG-5340 Amino Acid
(SEQ ID NO: 939)
VFTLEDFVGDWKQTAAYNLDQVLEQGGVSSLLQNLAVSVTPIQRMVRSGE
NALKIDIHVIIPYEGLSADQMAQIEEVFKVVYPVDDHHFKVILPYGTLVI
DGVTPNMLNYFGRPYEGIAVFDGKKITVTGTLWNGVKIIDERLITPDGSM
SFQVTINS ATG-5407 V135A Nucleotide
(SEQ ID NO: 940)
GTCTTCACACTCGAAGATTTCGTTGGGGACTGGAAACAGACAGCCGCCTA

```
CAACCTGGACCAAGTCCTTGAACAGGGAGGTGTGTCCAGTTTGCTGCAGA

ATCTCGCCGTGTCCGTAACTCCGATCCAAAGGATGGTCCGGAGCGGTGAA

AATGCCCTGAAGATCGACATCCATGTCATCATCCCGTATGAAGGTCTGAG

CGCCGACCAAATGGCCCAGATCGAAGAGGTGTTTAAGGTGGTGTACCCTG

TGGATGATCATCACTTTAAGGTGATCCTGCCCTATGGCACACTGGTAATC

GACGGGGTTACGCCGAACATGCTGAACTATTTCGGACGGCCGTATGAAGG

CATCGCCGTGTTCGACGGCAAAAAGATCACTGTAACAGGGACCCTGTGGA

ACGGCGCCAAAATTATCGACGAGCGCCTGATCACCCCCGACGGCTCCATG

TCCTTCCGAGTAACCATCAACAGC
```
ATG-5407 V135A Amino Acid
(SEQ ID NO: 941)
```
VFTLEDFVGDWKQTAAYNLDQVLEQGGVSSLLQNLAVSVTPIQRMVRSGE
NALKIDIHVIIPYEGLSADQMAQIEEVFKVVYPVDDHHFKVILPYGTLVI
DGVTPNMLNYFGRPYEGIAVFDGKKITVTGTLWNGAKIIDERLITPDGSM
SFRVTINS
```
ATG-5408 D156N Nucleotide
(SEQ ID NO: 942)
```
GTCTTCACACTCGAAGATTTCGTTGGGGACTGGAACCAGACAGCCGCCTA

CAACCTGGACCAAGTCCTTGAACAGGGAGGTGTGTCCAGTTTGCTGCAGA

ATCTCGCCGTGTCCGTAACTCCGATCCAAAGGATGGTCCGGAGCGGTGAA

AATGCCCTGAAGATCGACATCCATGTCATCATCCCGTATGAAGGTCTGAG

CGCCGACCAAATGGCCCAGATCGAAGAGGTGTTTAAGGTGGTGTACCCTG

TGGATGATCATCACTTTAAGGTGATCCTGCCCTATGGCACACTGGTAATC

GACGGGGTTACGCCGAACATGCTGAACTATTTCGGACGGCCGTATGAAGG

CATCGCCGTGTTCGACGGCAAAAAGATCACTGTAACAGGGACCCTGTGGA

ACGGCGTCAAAATTATCGACGAGCGCCTGATCACCCCCGACGGCTCCATG

TCCTTCCGAGTAACCATCGACAGC
```
ATG-5408 D156N Amino Acid
(SEQ ID NO: 943)
```
VFTLEDFVGDWNQTAAYNLDQVLEQGGVSSLLQNLAVSVTPIQRMVRSGE
NALKIDIHVIIPYEGLSADQMAQIEEVFKVVYPVDDHHFKVILPYGTLVI
DGVTPNMLNYFGRPYEGIAVFDGKKITVTGTLWNGVKIIDERLITPDGSM
SFRVTIDS
```
ATG-5409 H57Q Nucleotide
(SEQ ID NO: 944)
```
GTCTTCACACTCGAAGATTTCGTTGGGGACTGGAAACAGACAGCCGCCTA

CAACCTGGACCAAGTCCTTGAACAGGGAGGTGTGTCCAGTTTGCTGCAGA

ATCTCGCCGTGTCCGTAACTCCGATCCAAAGGATGGTCCGGAGCGGTGAA

AATGCCCTGAAGATCGACATCCAAGTCATCATCCCGTATGAAGGTCTGAG

CGCCGACCAAATGGCCCAGATCGAAGAGGTGTTTAAGGTGGTGTACCCTG

TGGATGATCATCACTTTAAGGTGATCCTGCCCTATGGCACACTGGTAATC

GACGGGGTTACGCCGAACATGCTGAACTATTTCGGACGGCCGTATGAAGG

CATCGCCGTGTTCGACGGCAAAAAGATCACTGTAACAGGGACCCTGTGGA

ACGGCGTCAAAATTATCGACGAGCGCCTGATCACCCCCGACGGCTCCATG

TCCTTCCGAGTAACCATCAACAGC
```
ATG-5409 H57Q Amino Acid
(SEQ ID NO: 945)
```
VFTLEDFVGDWKQTAAYNLDQVLEQGGVSSLLQNLAVSVTPIQRMVRSGE
NALKIDIQVIIPYEGLSADQMAQIEEVFKVVYPVDDHHFKVILPYGTLVI
DGVTPNMLNYFGRPYEGIAVFDGKKITVTGTLWNGVKIIDERLITPDGSM
SFRVTINS
```
ATG-5411 N33K + I155V Nucleotide
(SEQ ID NO: 946)
```
GTCTTCACACTCGAAGATTTCGTTGGGGACTGGAAACAGACAGCCGCCTA

CAACCTGGACCAAGTCCTTGAACAGGGAGGTGTGTCCAGTTTGCTGCAGA

AACTCGCCGTGTCCGTAACTCCGATCCAAAGGATGGTCCGGAGCGGTGAA

AATGCCCTGAAGATCGACATCCACGTCATCATCCCGTATGAAGGTCTGAG

CGCCGACCAAATGGCCCAGATCGAAGAGGTGTTTAAGGTGGTGTACCCTG

TGGATGATCATCACTTTAAGGTGATCCTGCCCTATGGCACACTGGTAATC

GACGGGGTTACGCCGAACATGCTGAACTATTTCGGACGGCCGTATGAAGG

CATCGCCGTGTTCGACGGCAAAAAGATCACTGTAACAGGGACCCTGTGGA

ACGGCGTCAAAATTATCGACGAGCGCCTGATCACCCCCGACGGCTCCATG

TCCTTCCGAGTAACCGTCAACAGC
```
ATG-5411 N33K + I155V Amino Acid
(SEQ ID NO: 947)
```
VFTLEDFVGDWKQTAAYNLDQVLEQGGVSSLLQKLAVSVTPIQRMVRSGE
NALKIDIHVIIPYEGLSADQMAQIEEVFKVVYPVDDHHFKVILPYGTLVI
DGVTPNMLNYFGRPYEGIAVFDGKKITVTGTLWNGVKIIDERLITPDGSM
SFRVTVNS
```
ATG-5412 I54V + L127A Nucleotide
(SEQ ID NO: 948)
```
GTCTTCACACTCGAAGATTTCGTTGGGGACTGGAAACAGACAGCCGCCTA

CAACCTGGACCAAGTCCTTGAACAGGGAGGTGTGTCCAGTTTGCTGCAGA

ATCTCGCCGTGTCCGTAACTCCGATCCAAAGGATGGTCCGGAGCGGTGAA

AATGCCCTGAAGGTCGACATCCATGTCATCATCCCGTATGAAGGTCTGAG

CGCCGACCAAATGGCCCAGATCGAAGAGGTGTTTAAGGTGGTGTACCCTG

TGGATGATCATCACTTTAAGGTGATCCTGCCCTATGGCACACTGGTAATC

GACGGGGTTACGCCGAACATGCTGAACTATTTCGGACGGCCGTATGAAGG

CATCGCCGTGTTCGACGGCAAAAAGATCACTGCAACAGGGACCCTGTGGA

ACGGCGTCAAAATTATCGACGAGCGCCTGATCACCCCCGACGGCTCCATG

TCCTTCCGAGTAACCATCAACAGC
```
ATG-5412 I54V + L127A Amino Acid
(SEQ ID NO: 949)
```
VFTLEDFVGDWKQTAAYNLDQVLEQGGVSSLLQNLAVSVTPIQRMVRSGE
NALKVDIHVIIPYEGLSADQMAQIEEVFKVVYPVDDHHFKVILPYGTLVI
DGVTPNMLNYFGRPYEGIAVFDGKKITATGTLWNGVKIIDERLITPDGSM
SFRVTINS
```
ATG-5413 M44L + V135A Nucleotide
(SEQ ID NO: 950)
```
GTCTTCACACTCGAAGATTTCGTTGGGGACTGGAAACAGACAGCCGCCTA

CAACCTGGACCAAGTCCTTGAACAGGGAGGTGTGTCCAGTTTGCTGCAGA
```

-continued
ATCTCGCCGTGTCCGTAACTCCGATCCAAAGGTTGGTCCGGAGCGGTGAA
AATGCCCTGAAGATCGACATCCATGTCATCATCCCGTATGAAGGTCTGAG
CGCCGACCAAATGGCCCAGATCGAAGAGGTGTTTAAGGTGGTGTACCCTG
TGGATGATCATCACTTTAAGGTGATCCTGCCCTATGGCACACTGGTAATC
GACGGGGTTACGCCGAACATGCTGAACTATTTCGGACGGCCGTATGAAGG
CATCGCCGTGTTCGACGGCAAAAAGATCACTGTAACAGGGACCCTGTGGA
ACGGCGCCAAAATTATCGACGAGCGCCTGATCACCCCCGACGGCTCCATG
TCCTTCCGAGTAACCATCAACAGC ATG-5413 M44L + V135A Amino Acid
(SEQ ID NO: 951)
VFTLEDFVGDWKQTAAYNLDQVLEQGGVSSLLQNLAVSVTPIQRLVRSG
ENALKIDIHVIIPYEGLSADQMAQIEEVFKVVYPVDDHHFKVILPYGTL
VIDGVTPNMLNYFGRPYEGIAVFDGKKITVTGTLWNGAKIIDERLITPD
GSMSFRVTINS ATG-5414 V119A Nucleotide
(SEQ ID NO: 952)
GTCTTCACACTCGAAGATTTCGTTGGGGACTGGAAACAGACAGCCGCCTA
CAACCTGGACCAAGTCCTTGAACAGGGAGGTGTGTCCAGTTTGCTGCAGA
ATCTCGCCGTGTCCGTAACTCCGATCCAAAGGATGGTCCGGAGCGGTGAA
AATGCCCTGAAGATCGACATCCATGTCATCATCCCGTATGAAGGTCTGAG
CGCCGACCAAATGGCCCAGATCGAAGAGGTGTTTAAGGTGGTGTACCCTG
TGGATGATCATCACTTTAAGGTGATCCTGCCCTATGGCACACTGGTAATC
GACGGGGTTACGCCGAACATGCTGAACTATTTCGGACGGCCGTATGAAGG
CATCGCCGCGTTCGACGGCAAAAAGATCACTGTAACAGGGACCCTGTGGA
ACGGCGTCAAAATTATCGACGAGCGCCTGATCACCCCCGACGGCTCCATG
TCCTTCCGAGTAACCATCAACAGC ATG-5414 V119A (Amino Acid)
(SEQ ID NO: 953)
VFTLEDFVGDWKQTAAYNLDQVLEQGGVSSLLQNLAVSVTPIQRMVRSGE
NALKIDIHVIIPYEGLSADQMAQIEEVFKVVYPVDDHHFKVILPYGTLVI
DGVTPNMLNYFGRPYEGIAAFDGKKITVTGTLWNGVKIIDERLITPDGSM
SFRVTINS ATG-5416 D9A + H57Q Nucleotide
(SEQ ID NO: 954)
GTCTTCACACTCGAAGATTTCGTTGGGGCCTGGAAACAGACAGCCGCCTA
CAACCTGGACCAAGTCCTTGAACAGGGAGGTGTGTCCAGTTTGCTGCAGA
ATCTCGCCGTGTCCGTAACTCCGATCCAAAGGATGGTCCGGAGCGGTGAA
AATGCCCTGAAGATCGACATCCAAGTCATCATCCCGTATGAAGGTCTGAG
CGCCGACCAAATGGCCCAGATCGAAGAGGTGTTTAAGGTGGTGTACCCTG
TGGATGATCATCACTTTAAGGTGATCCTGCCCTATGGCACACTGGTAATC
GACGGGGTTACGCCGAACATGCTGAACTATTTCGGACGGCCGTATGAAGG
CATCGCCGTGTTCGACGGCAAAAAGATCACTGTAACAGGGACCCTGTGGA
ACGGCGTCAAAATTATCGACGAGCGCCTGATCACCCCCGACGGCTCCATG
TCCTTCCGAGTAACCATCAACAGC ATG-5416 D9A + H57Q (Amino Acid)
(SEQ ID NO: 955)
VFTLEDFVGAWKQTAAYNLDQVLEQGGVSSLLQNLAVSVTPIQRMVRSGE
NALKIDIQVIIPYEGLSADQMAQIEEVFKVVYPVDDHHFKVILPYGTLVI
DGVTPNMLNYFGRPYEGIAVFDGKKITVTGTLWNGVKIIDERLITPDGSM
SFRVTINS ATG-5417 N33D + I41T Nucleotide
(SEQ ID NO: 956)
GTCTTCACACTCGAAGATTTCGTAGGGGACTGGAAACAGACAGCCGCCTA
CAACCTGGACCAAGTCCTTGAACAGGGAGGTGTGTCCAGTTTGCTGCAGG
ATCTCGCCGTGTCCGTAACTCCGACCCAAAGGATGGTCCGGAGCGGTGAA
AATGCCCTGAAGATCGACATCCATGTCATCATCCCGTATGAAGGTCTGAG
CGCCGACCAAATGGCCCAGATCGAAGAGGTGTTTAAGGTGGTGTACCCTG
TGGATGATCATCACTTTAAGGTGATCCTGCCCTATGGCACACTGGTAATC
GACGGGGTTACGCCGAACATGCTGAACTATTTCGGACGGCCGTATGAAGG
CATCGCCGTGTTCGACGGCAAAAAGATCACTGTAACAGGGACCCTGTGGA
ACGGCGTCAAAATTATCGACGAGCGCCTGATCACCCCCGACGGCTCCATG
TCCTTCCGAGTAACCATCAACAGC ATG-5417 N33D + I41T Amino Acid
(SEQ ID NO: 957)
VFTLEDFVGDWKQTAAYNLDQVLEQGGVSSLLQDLAVSVTPTQRMVRSGE
NALKIDIHVIIPYEGLSADQMAQIEEVFKVVYPVDDHHFKVILPYGTLVI
DGVTPNMLNYFGRPYEGIAVFDGKKITVTGTLWNGVKIIDERLITPDGSM
SFRVTINS ATG-5418 Q32R + I155T Nucleotide
(SEQ ID NO: 958)
GTCTTCACACTCGAAGATTTCGTTGGGGACTGGAGACAGACTGCCGCCTA
CAACCTGGACCAAGTCCTTGAACAGGGAGGTGTGTCCAGTTTGCTGCGGA
ATCTCGCCGTGTCCGTAACTCCGATCCAAAGGATGGTCCGGAGCGGTGAA
AATGCCCTGAAGATCGACATCCATGTCATCATCCCGTATGAAGGTCTGAG
CGCCGACCAAATGGCCCAGATCGAAGAGGTGTTTAAGGTGGTGTACCCTG
TGGATGATCATCACTTTAAGGTGATCCTGCCCTATGGCACACTGGTAATC
GACGGGGTTACGCCGAACATGCTGAACTATTTCGGACGGCCGTATGAAGG
CATCGCCGTGTTCGACGGCAAAAAGATCACTGTAACAGGGACCCTGTGGA
ACGGCGTCAAAATTATCGACGAGCGCCTGATCACCCCCGACGGCTCCATG
TCCTTCCGAGTAACCACCAACAGC ATG-5418 Q32R + I155T mino Acid
(SEQ ID NO: 959)
VFTLEDFVGDWRQTAAYNLDQVLEQGGVSSLLRNLAVSVTPIQRMVRSGE
NALKIDIHVIIPYEGLSADQMAQIEEVFKVVYPVDDHHFKVILPYGTLVI
DGVTPNMLNYFGRPYEGIAVFDGKKITVTGTLWNGVKIIDERLITPDGSM
SFRVTTNS ATG-5419 D19V + M106T + V120L Nucleotide
(SEQ ID NO: 960)
GTCTTCACACTCGAAGATTTCGTTGGGGACTGGAAACAGACAGCCGCCTA
CAACCTGGTCCAAGTCCTTGAACAGGGAGGTGTGTCCAGTTTGCTGCAGA
ATCTCGCCGTGTCCGTAACTCCGATCCAAAGGATGGTCCGGAGCGGTGAA

AATGCCCTGAAGATCGACATCCATGTCATCATCCCGTATGAAGGTCTGAG

CGCCGACCAAATGGCCCAGATCGAAGAGGTGTTTAAGGTGGTGTACCCTG

TGGATGATCATCACTTTAAGGTGATCCTGCCCTATGGCACACTGGTAATC

GACGGGGTTACGCCGAACACGCTGAACTATTTCGGACGGCCGTATGAAGG

CATCGCCGTGCTCGACGGCAAAAAGATCACTGTAACAGGGACCCTGTGGA

ACGGCGTCAAAATTATCGACGAGCGCCTGATCACCCCCGACGGCTCCATG

TCCTTCCGAGTAACCATCAACAGC

ATG-5419 D19V + M106T + V120L Amino Acid
(SEQ ID NO: 961)
VFTLEDFVGDWKQTAAYNLVQVLEQGGVSSLLQNLAVSVTPIQRMVRSGE

NALKIDIHVIIPYEGLSADQMAQIEEVFKVVYPVDDHHFKVILPYGTLVI

DGVTPNTLNYFGRPYEGIAVLDGKKITVTGTLWNGVKIIDERLITPDGSM

SFRVTINS

ATG-5420 I41N + E63G Nucleotide
(SEQ ID NO: 962)
GTCTTCACACTCGAAGATTTCGTTGGGGACTGGAAACAGACAGCCGCCTA

CAACCTGGACCAAGTCCTTGAACAGGGAGGTGTGTCCAGTTTGCTGCAGA

ATCTCGCCGTGTCCGTAACTCCGAACCAAAGGATGGTCCGGAGCGGTGAA

AATGCCCTGAAGATCGACATCCATGTCATCATCCCGTATGGAGGTCTGAG

CGCCGACCAAATGGCCCAGATCGAAGAGGTGTTTAAGGTGGTGTACCCTG

TGGATGATCATCACTTTAAGGTGATCCTGCCCTATGGCACACTGGTAATC

GACGGGGTTACGCCGAACATGCTGAACTATTTCGGACGGCCGTATGAAGG

CATCGCCGTGTTCGACGGCAAAAAGATCACTGTGACAGGGACCCTGTGGA

ACGGCGTCAAAATTATCGACGAGCGCCTGATCACCCCCGACGGCTCCATG

TCCTTCCGAGTAACCATCAACAGC

ATG-5420 I41N + E63G Amino Acid
(SEQ ID NO: 963)
VFTLEDFVGDWKQTAAYNLDQVLEQGGVSSLLQNLAVSVTPNQRMVRSGE

NALKIDIHVIIPYGGLSADQMAQIEEVFKVVYPVDDHHFKVILPYGTLVI

DGVTPNMLNYFGRPYEGIAVFDGKKITVTGTLWNGVKIIDERLITPDGSM

SFRVTINS

ATG-5421 N50S Nucleotide
(SEQ ID NO: 964)
GTCTTCACACTCGAAGATTTCGTTGGGGACTGGAAACAGACAGCCGCCTA

CAACCTGGACCAAGTCCTTGAACAGGGAGGTGTGTCCAGTTTGCTGCAGA

ACCTCGCCGTGTCCGTAACTCCGATCCAAAGGATGGTCCGGAGCGGTGAA

AGTGCCCTGAAGATCGACATCCATGTCATCATCCCGTATGAAGGTCTGAG

CGCCGACCAAATGGCCCAGATCGAAGAGGTGTTTAAGGTGGTGTACCCTG

TGGATGATCATCACTTTAAGGTGATCCTGCCCTATGGCACACTGGTAATC

GACGGGGTTACGCCGAACATGCTGAACTATTTCGGACGGCCGTATGAAGG

CATCGCCGTGTTCGACGGCAAAAAGATCACTGTAACAGGGACCCTGTGGA

ACGGCGTCAAAATTATCGACGAGCGCCTGATCACCCCCGACGGCTCCATG

TCCTTCCGAGTAACCATCAACAGC

ATG-5421 N50S Amino Acid
(SEQ ID NO: 965)
VFTLEDFVGDWKQTAAYNLDQVLEQGGVSSLLQNLAVSVTPIQRMVRSGE

SALKIDIHVIIPYEGLSADQMAQIEEVFKVVYPVDDHHFKVILPYGTLVI

DGVTPNMLNYFGRPYEGIAVFDGKKITVTGTLWNGVKIIDERLITPDGSM

SFRVTINS

ATG-5432 L3H Nucleotide
(SEQ ID NO: 966)
GTCTTCACACACGAAGATTTCGTTGGGGACTGGAAACAGACAGCCGCCTA

CAACCTGGACCAAGTCCTTGAACAGGGAGGTGTGTCCAGTTTGCTGCAGA

ATCTCGCCGTGTCCGTAACTCCGATCCAAAGGATGGTCCGGAGCGGTGAA

AATGCCCTGAAGATCGACATCCATGTCATCATCCCGTATGAAGGTCTGAG

CGCCGACCAAATGGCCCAGATCGAAGAGGTGTTTAAGGTGGTGTACCCTG

TGGATGATCATCACTTTAAGGTGATCCTGCCCTATGGCACACTGGTAATC

GACGGGGTTACGCCGAACATGCTGAACTATTTCGGACGGCCGTATGAAGG

CATCGCCGTGTTCGACGGCAAAAAGATCACTGTAACAGGGACCCTGTGGA

ACGGCGTCAAAATTATCGACGAGCGCCTGATCACCCCCGACGGCTCCATG

TCCTTCCGAGTAACCATCAACAGC

ATG-5432 Amino Acid
(SEQ ID NO: 967)
VFTHEDFVGDWKQTAAYNLDQVLEQGGVSSLLQNLAVSVTPIQRMVRSGE

NALKIDIHVIIPYEGLSADQMAQIEEVFKVVYPVDDHHFKVILPYGTLVI

DGVTPNMLNYFGRPYEGIAVFDGKKITVTGTLWNGVKIIDERLITPDGSM

SFRVTINS

ATG-5433 T13S Nucleotide
(SEQ ID NO: 968)
GTCTTCACACTCGAAGATTTCGTTGGGGACTGGAAACAGTCAGCCGCCTA

CAACCTGGACCAAGTCCTTGAACAGGGAGGTGTGTCCAGTTTGCTGCAGA

ATCTCGCCGTGTCCGTAACTCCGATCCAAAGGATGGTCCGGAGCGGTGAA

AATGCCCTGAAGATCGACATCCATGTCATCATCCCGTATGAAGGTCTGAG

CGCCGACCAAATGGCCCAGATCGAAGAGGTGTTTAAGGTGGTGTACCCTG

TGGATGATCATCACTTTAAGGTGATCCTGCCCTATGGCACACTGGTAATC

GACGGGGTTACGCCGAACATGCTGAACTATTTCGGACGGCCGTATGAAGG

CATCGCCGTGTTCGACGGCAAAAAGATCACTGTAACAGGGACCCTGTGGA

ACGGCGTCAAAATTATCGACGAGCGCCTGATCACCCCCGACGGCTCCATG

TCCTTCCGAGTAACCATCAACAGC

ATG-5433 T13S Amino Acid
(SEQ ID NO: 969)
VFTLEDFVGDWKQSAAYNLDQVLEQGGVSSLLQNLAVSVTPIQRMVRSGE

NALKIDIHVIIPYEGLSADQMAQIEEVFKVVYPVDDHHFKVILPYGTLVI

DGVTPNMLNYFGRPYEGIAVFDGKKITVTGTLWNGVKIIDERLITPDGSM

SFRVTINS

ATG-5434 P93H Nucleotide
(SEQ ID NO: 970)
GTCTTCACACTCGAAGATTTCGTTGGGGACTGGAAACAGACAGCCGCCTA

CAACCTGGACCAAGTCCTTGAACAGGGAGGTGTGTCCAGTTTGCTGCAGA

ATCTCGCCGTGTCCGTAACTCCGATCCAAAGGATGGTCCGGAGCGGTGAA

AATGCCCTGAAGATCGACATCCATGTCATCATCCCGTATGAAGGTCTGAG

-continued
CGCCGACCAAATGGCCCAGATCGAAGAGGTGTTTAAGGTGGTGTACCCTG
TGGATGATCATCACTTTAAGGTGATCCTGCACTATGGCACACTGGTAATC
GACGGGGTTACGCCGAACATGCTGAACTATTTCGGACGGCCGTATGAAGG
CATCGCCGTGTTCGACGGCAAAAAGATCACTGTAACAGGGACCCTGTGGA
ACGGCGTCAAAATTATCGACGAGCGCCTGATCACCCCCGACGGCTCCATG
TCCTTCCGAGTAACCATCAACAGC ATG-5434 P93H Amino Acid
(SEQ ID NO: 117)
VFTLEDFVGDWKQTAAYNLDQVLEQGGVSSLLQNLAVSVTPIQRMVRSGE
NALKIDIHVIIPYEGLSADQMAQIEEVFKVVYPVDDHHFKVILHYGTLVI
DGVTPNMLNYFGRPYEGIAVFDGKKITVTGTLWNGVKIIDERLITPDGSM
SFRVTINS ATG-5435 F120L Nucleotide
(SEQ ID NO: 118)
GTCTTCACACTCGAAGATTTCGTTGGGGACTGGAAACAGACAGCCGCCTA
CAACCTGGACCAAGTCCTTGAACAGGGAGGTGTGTCCAGTTTGCTGCAGA
ATCTCGCCGTGTCCGTAACTCCGATCCAAAGGATGGTCCGGAGCGGTGAA
AATGCCCTGAAGATCGACATCCATGTCATCATCCCGTATGAAGGTCTGAG
CGCCGACCAAATGGCCCAGATCGAAGAGGTGTTTAAGGTGGTGTACCCTG
TGGATGATCATCACTTTAAGGTGATCCTGCCCTATGGCACACTGGTAATC
GACGGGGTTACGCCGAACATGCTGAACTATTTCGGACGGCCGTATGAAGG
CATCGCCGTGCTCGACGGCAAAAAGATCACTGTAACAGGGACCCTGTGGA
ACGGCGTCAAAATTATAGACGAGCGCCTGATCACCCCCGACGGCTCCATG
TCCTTCCGAGTAACCATCAACAGC ATG-5435 F120L Amino Acid
(SEQ ID NO: 119)
VFTLEDFVGDWKQTAAYNLDQVLEQGGVSSLLQNLAVSVTPIQRMVRSGE
NALKIDIHVIIPYEGLSADQMAQIEEVFKVVYPVDDHHFKVILPYGTLVI
DGVTPNMLNYFGRPYEGIAVLDGKKITVTGTLWNGVKIIDERLITPDGSM
SFRVTINS ATG-5437 S157R Nucleotide
(SEQ ID NO: 120)
GTCTTCACACTCGAAGATTTCGTTGGGGACTGGAAACAGACAGCCGCCTA
CAACCTGGACCAAGTCCTTGAACAGGGAGGTGTGTCCAGTTTGCTGCAGA
ATCTCGCCGTGTCCGTAACTCCGATCCAAAGGATGGTCCGGAGCGGTGAA
AATGCCCTGAAGATCGACATCCATGTCATCATCCCGTATGAAGGTCTGAG
CGCCGACCAAATGGCCCAGATCGAAGAGGTGTTTAAGGTGGTGTACCCTG
TGGATGATCATCACTTTAAGGTGATCCTGCCCTATGGCACACTGGTAATC
GACGGGGTTACGCCGAACATGCTGAACTATTTCGGACGGCCGTATGAAGG
CATCGCCGTGTTCGACGGCAAAAAGATCACTGTAACAGGGACCCTGTGGA
ACGGCGTCAAAATTATCGACGAGCGCCTGATCACCCCCGACGGCTCCATG
TCCTTCCGAGTAACCATCAACCGC ATG-5437 S157R Amino Acid
(SEQ ID NO: 121)
VFTLEDFVGDWKQTAAYNLDQVLEQGGVSSLLQNLAVSVTPIQRMVRSGE
NALKIDIHVIIPYEGLSADQMAQIEEVFKVVYPVDDHHFKVILPYGTLVI
DGVTPNMLNYFGRPYEGIAVFDGKKITVTGTLWNGVKIIDERLITPDGSM
SFRVTINR ATG-5438 H86L Nucleotide
(SEQ ID NO: 122)
GTCTTCACACTCGAAGATTTCGTTGGGGACTGGAAACAGACAGCCGCCTA
CAACCTGGACCAAGTCCTTGAACAGGGAGGTGTGTCCAGTTTGCTGCAGA
ATCTCGCCGTGTCCGTAACTCCGATCCAAAGGATGGTCCGGAGCGGTGAA
AATGCCCTGAAGATCGACATCCATGTCATCATCCCGTATGAAGGTCTGAG
CGCCGACCAAATGGCCCAGATCGAAGAGGTGTTTAAGGTGGTGTACCCTG
TGGATGATCTTCACTTTAAGGTGATCCTGCCCTATGGCACACTGGTAATC
GACGGGGTTACGCCGAACATGCTGAACTATTTCGGACGGCCGTATGAAGG
CATCGCCGTGTTCGACGGCAAAAAGATCACTGTAACAGGGACCCTGTGGA
ACGGCGTCAAAATTATCGACGAGCGCCTGATCACCCCCGACGGCTCCATG
TCCTTCCGAGTAACCATCAACAGC ATG-5438 H86L Amino Acid
(SEQ ID NO: 123)
VFTLEDFVGDWKQTAAYNLDQVLEQGGVSSLLQNLAVSVTPIQRMVRSGE
NALKIDIHVIIPYEGLSADQMAQIEEVFKVVYPVDDLHFKVILPYGTLVI
DGVTPNMLNYFGRPYEGIAVFDGKKITVTGTLWNGVKIIDERLITPDGSM
SFRVTINS ATG-5439 M149V Nucleotide
(SEQ ID NO: 124)
GTCTTCACACTCGAAGATTTCGTTGGGGACTGGAAACAGACAGCCGCCTA
CAACCTGGACCAAGTCCTTGAACAGGGAGGTGTGTCCAGTTTGCTGCAGA
ATCTCGCCGTGTCCGTAACTCCGATCCAAAGGATGGTCCGGAGCGGTGAA
AATGCCCTGAAGATCGACATCCATGTCATCATCCCGTATGAAGGTCTGAG
CGCCGACCAAATGGCCCAGATCGAAGAGGTGTTTAAGGTGGTGTACCCTG
TGGATGATCATCACTTTAAGGTGATCCTGCCCTATGGCACACTGGTAATC
GACGGGGTTACGCCGAACATGCTGAACTATTTCGGACGGCCGTATGAAGG
CATCGCCGTGTTCGACGGCAAAAAGATCACTGTAACAGGGACCCTGTGGA
ACGGCGTCAAAATTATCGACGAGCGCCTGATCACCCCCGACGGCTCCGTG
TCCTTCCGAGTAACCATCAACAGC ATG-5439 M149V Amino Acid
(SEQ ID NO: 125)
VFTLEDFVGDWKQTAAYNLDQVLEQGGVSSLLQNLAVSVTPIQRMVRSGE
NALKIDIHVIIPYEGLSADQMAQIEEVFKVVYPVDDHHFKVILPYGTLVI
DGVTPNMLNYFGRPYEGIAVFDGKKITVTGTLWNGVKIIDERLITPDGSV
SFRVTINS ATG-5440 I59V Nucleotide
(SEQ ID NO: 126)
GTCTTCACACTCGAAGATTTCGTTGGGGACTGGAAACAGACAGCCGCCTA
CAACCTGGACCAAGTCCTTGAACAGGGAGGTGTGTCCAGTTTGCTGCAGA
ATCTTGCCGTGTCCGTAACTCCGATCCAAAGGATGGTCCGGAGCGGTGAA
AATGCCCTGAAGATCGACATCCATGTCGTCATCCCGTATGAAGGTCTGAG
CGCCGACCAAATGGCCCAGATCGAAGAGGTGTTTAAGGTGGTGTACCCTG -continued
TGGATGATCATCACTTTAAGGTGATCCTGCCCTATGGCACACTGGTAATC

GACGGGGTTACGCCGAACATGCTGAACTATTTCGGACGGCCGTATGAAGG

CATCGCCGTGTTCGACGGCAAAAAGATCACTGTAACAGGGACCCTGTGGA

ACGGCGTCAAAATTATCGACGAGCGCCTGATCACCCCCGACGGCTCCATG

TCCTTCCGAGTAACCATCAACAGC

ATG-5440 I59V Amino Acid
(SEQ ID NO: 127)
VFTLEDFVGDWKQTAAYNLDQVLEQGGVSSLLQNLAVSVTPIQRMVRSGE

NALKIDIHVVIPYEGLSADQMAQIEEVFKVVYPVDDHHFKVILPYGTLVI

DGVTPNMLNYFGRPYEGIAVFDGKKITVTGTLWNGVKIIDERLITPDGSM

SFRVTINS

ATG-5441 D19A Nucleotide
(SEQ ID NO: 128)
GTCTTCACACTCGAAGATTTCGTTGGGGACTGGAAACAGACAGCCGCCTA

CAACCTGGCCCAAGTCCTTGAACAGGGAGGTGTGTCCAGTTTGCTGCAGA

ATCTCGCCGTGTCCGTAACTCCGATCCAAAGGATGGTCCGGAGCGGTGAA

AATGCCCTGAAGATCGACATCCATGTCATCATCCCGTATGAAGGTCTGAG

CGCCGACCAAATGGCCCAGATCGAAGAGGTGTTTAAGGTGGTGTACCCTG

TGGATGATCATCACTTTAAGGTGATCCTGCCCTATGGCACACTGGTAATC

GACGGGGTTACGCCGAACATGCTGAACTATTTCGGACGGCCGTATGAAGG

CATCGCCGTGTTCGACGGCAAAAAGATCACTGTAACAGGGACCCTGTGGA

ACGGCGTCAAAATTATCGACGAGCGCCTGATCACCCCCGACGGCTCCATG

TCCTTCCGAGTAACCATCAACAGC

ATG-5441 D19A Amino Acid
(SEQ ID NO: 129)
VFTLEDFVGDWKQTAAYNLAQVLEQGGVSSLLQNLAVSVTPIQRMVRSGE

NALKIDIHVIIPYEGLSADQMAQIEEVFKVVYPVDDHHFKVILPYGTLVI

DGVTPNMLNYFGRPYEGIAVFDGKKITVTGTLWNGVKIIDERLITPDGSM

SFRVTINS

ATG-5442 Q69L + T144S Nucleotide
(SEQ ID NO: 130)
GTCTTCACACTCGAAGATTTCGTTGGGGACTGGAAACAGACAGCCGCCTA

CAACCTGGACCAAGTCCTTGAACAGGGAGGTGTGTCCAGTTTGCTGCAGA

ATCTCGCCGTGTCCGTAACTCCGATCCAAAGGATGGTCCGGAGCGGTGAA

AATGCCCTGAAGATCGACATCCATGTCATCATCCCGTATGAAGGTCTGAG

CGCCGACCTAATGGCCCAGATCGAAGAGGTGTTTAAGGTGGTGTACCCTG

TGGATGATCATCACTTTAAGGTGATCCTGCCCTATGGCACACTGGTAATC

GACGGGGTTACGCCGAACATGCTGAACTATTTCGGACGGCCGTATGAAGG

CATCGCCGTATTCGACGGCAAAAAGATCACTGTAACAGGGACCCTGTGGA

ACGGCGTCAAAATTATCGACGAGCGCCTGATCTCCCCCGACGGCTCCATG

TCCTTCCGAGTAACCATCAACAGC

ATG-5442 Q69L + T144S Amino Acid
(SEQ ID NO: 131)
VFTLEDFVGDWKQTAAYNLDQVLEQGGVSSLLQNLAVSVTPIQRMVRSGE

NALKIDIHVIIPYEGLSADLMAQIEEVFKVVYPVDDHHFKVILPYGTLVI

DGVTPNMLNYFGRPYEGIAVFDGKKITVTGTLWNGVKIIDERLISPDGSM

SFRVTINS

ATG-5456 K11Y Nucleotide
(SEQ ID NO: 132)
GTCTTCACACTCGAAGATTTCGTTGGGGACTGGTACCAGACAGCCGCCTA

CAACCTGGACCAAGTCCTTGAACAGGGAGGTGTGTCCAGTTTGCTGCAGA

ATCTCGCCGTGTCCGTAACTCCGATCCAAAGGATGGTCCGGAGCGGTGAA

AATGCCCTGAAGATCGACATCCATGTCATCATCCCGTATGAAGGTCTGAG

CGCCGACCAAATGGCCCAGATCGAAGAGGTGTTTAAGGTGGTGTACCCTG

TGGATGATCATCACTTTAAGGTGATCCTGCCCTATGGCACACTGGTAATC

GACGGGGTTACGCCGAACATGCTGAACTATTTCGGACGGCCGTATGAAGG

CATCGCCGTGTTCGACGGCAAAAAGATCACTGTAACAGGGACCCTGTGGA

ACGGCGTCAAAATTATCGACGAGCGCCTGATCACCCCCGACGGCTCCATG

TCCTTCCGAGTAACCATCAACAGC

ATG-5456 K11Y Nucleotide Amino Acid
(SEQ ID NO: 596)
VFTLEDFVGDWYQTAAYNLDQVLEQGGVSSLLQNLAVSVTPIQRMVRSGE

NALKIDIHVIIPYEGLSADQMAQIEEVFKVVYPVDDHHFKVILPYGTLVI

DGVTPNMLNYFGRPYEGIAVFDGKKITVTGTLWNGVKIIDERLITPDGSM

SFRVTINS

ATG-5457 K11R Nucleotide
(SEQ ID NO: 597)
GTCTTCACACTCGAAGATTTCGTTGGGGACTGGCGGCAGACAGCCGCCTA

CAACCTGGACCAAGTCCTTGAACAGGGAGGTGTGTCCAGTTTGCTGCAGA

ATCTCGCCGTGTCCGTAACTCCGATCCAAAGGATGGTCCGGAGCGGTGAA

AATGCCCTGAAGATCGACATCCATGTCATCATCCCGTATGAAGGTCTGAG

CGCCGACCAAATGGCCCAGATCGAAGAGGTGTTTAAGGTGGTGTACCCTG

TGGATGATCATCACTTTAAGGTGATCCTGCCCTATGGCACACTGGTAATC

GACGGGGTTACGCCGAACATGCTGAACTATTTCGGACGGCCGTATGAAGG

CATCGCCGTGTTCGACGGCAAAAAGATCACTGTAACAGGGACCCTGTGGA

ACGGCGTCAAAATTATCGACGAGCGCCTGATCACCCCCGACGGCTCCATG

TCCTTCCGAGTAACCATCAACAGC

ATG-5457 K11R Amino Acid
(SEQ ID NO: 598)
VFTLEDFVGDWRQTAAYNLDQVLEQGGVSSLLQNLAVSVTPIQRMVRSGE

NALKIDIHVIIPYEGLSADQMAQIEEVFKVVYPVDDHHFKVILPYGTLVI

DGVTPNMLNYFGRPYEGIAVFDGKKITVTGTLWNGVKIIDERLITPDGSM

SFRVTINS

ATG-5458 K11L Nucleotide
(SEQ ID NO: 599)
GTCTTCACACTCGAAGATTTCGTTGGGGACTGGCTGCAGACAGCCGCCTA

CAACCTGGACCAAGTCCTTGAACAGGGAGGTGTGTCCAGTTTGCTGCAGA

ATCTCGCCGTGTCCGTAACTCCGATCCAAAGGATGGTCCGGAGCGGTGAA

AATGCCCTGAAGATCGACATCCATGTCATCATCCCGTATGAAGGTCTGAG

CGCCGACCAAATGGCCCAGATCGAAGAGGTGTTTAAGGTGGTGTACCCTG

TGGATGATCATCACTTTAAGGTGATCCTGCCCTATGGCACACTGGTAATC

-continued

```
GACGGGGTTACGCCGAACATGCTGAACTATTTCGGACGGCCGTATGAAGG

CATCGCCGTGTTCGACGGCAAAAAGATCACTGTAACAGGGACCCTGTGGA

ACGGCGTCAAAATTATCGACGAGCGCCTGATCACCCCCGACGGCTCCATG

TCCTTCCGAGTAACCATCAACAGC
```

ATG-5458 K11L Amino Acid
(SEQ ID NO: 600)
```
VFTLEDFVGDWLQTAAYNLDQVLEQGGVSSLLQNLAVSVTPIQRMVRSGE

NALKIDIHVIIPYEGLSADQMAQIEEVFKVVYPVDDHHFKVILPYGTLVI

DGVTPNMLNYFGRPYEGIAVFDGKKITVTGTLWNGVKIIDERLITPDGSM

SFRVTINS
```

ATG-5459 R152Q Nucleotide
(SEQ ID NO: 601)
```
GTCTTCACACTCGAAGATTTCGTTGGGGACTGGAACCAGACAGCCGCCTA

CAACCTGGACCAAGTCCTTGAACAGGGAGGTGTGTCCAGTTTGCTGCAGA

ATCTCGCCGTGTCCGTAACTCCGATCCAAAGGATGGTCCGGAGCGGTGAA

AATGCCCTGAAGATCGACATCCATGTCATCATCCCGTATGAAGGTCTGAG

CGCCGACCAAATGGCCCAGATCGAAGAGGTGTTTAAGGTGGTGTACCCTG

TGGATGATCATCACTTTAAGGTGATCCTGCCCTATGGCACACTGGTAATC

GACGGGGTTACGCCGAACATGCTGAACTATTTCGGACGGCCGTATGAAGG

CATCGCCGTGTTCGACGGCAAAAAGATCACTGTAACAGGGACCCTGTGGA

ACGGCGTCAAAATTATCGACGAGCGCCTGATCACCCCCGACGGCTCCATG

TCCTTCCAGGTAACCATCAACAGC
```

ATG-5459 R152Q Amino Acid
(SEQ ID NO: 602)
```
VFTLEDFVGDWNQTAAYNLDQVLEQGGVSSLLQNLAVSVTPIQRMVRSGE

NALKIDIHVIIPYEGLSADQMAQIEEVFKVVYPVDDHHFKVILPYGTLVI

DGVTPNMLNYFGRPYEGIAVFDGKKITVTGTLWNGVKIIDERLITPDGSM

SFQVTINS
```

ATG-5460 N156D Nucleotide
(SEQ ID NO: 603)
```
GTCTTCACACTCGAAGATTTCGTTGGGGACTGGAACCAGACAGCCGCCTA

CAACCTGGACCAAGTCCTTGAACAGGGAGGTGTGTCCAGTTTGCTGCAGA

ATCTCGCCGTGTCCGTAACTCCGATCCAAAGGATGGTCCGGAGCGGTGAA

AATGCCCTGAAGATCGACATCCATGTCATCATCCCGTATGAAGGTCTGAG

CGCCGACCAAATGGCCCAGATCGAAGAGGTGTTTAAGGTGGTGTACCCTG

TGGATGATCATCACTTTAAGGTGATCCTGCCCTATGGCACACTGGTAATC

GACGGGGTTACGCCGAACATGCTGAACTATTTCGGACGGCCGTATGAAGG

CATCGCCGTGTTCGACGGCAAAAAGATCACTGTAACAGGGACCCTGTGGA

ACGGCGTCAAAATTATCGACGAGCGCCTGATCACCCCCGACGGCTCCATG

TCCTTCCGAGTAACCATCGACAGC
```

ATG-5460 N156D Amino Acid
(SEQ ID NO: 604)
```
VFTLEDFVGDWNQTAAYNLDQVLEQGGVSSLLQNLAVSVTPIQRMVRSGE

NALKIDIHVIIPYEGLSADQMAQIEEVFKVVYPVDDHHFKVILPYGTLVI

DGVTPNMLNYFGRPYEGIAVFDGKKITVTGTLWNGVKIIDERLITPDGSM

SFRVTIDS
```

ATG-5491 K11Q Nucleotide
(SEQ ID NO: 605)
```
GTCTTCACACTCGAAGATTTCGTTGGGGACTGGCAGCAGACAGCCGCCTA

CAACCTGGACCAAGTCCTTGAACAGGGAGGTGTGTCCAGTTTGCTGCAGA

ATCTCGCCGTGTCCGTAACTCCGATCCAAAGGATGGTCCGGAGCGGTGAA

AATGCCCTGAAGATCGACATCCATGTCATCATCCCGTATGAAGGTCTGAG

CGCCGACCAAATGGCCCAGATCGAAGAGGTGTTTAAGGTGGTGTACCCTG

TGGATGATCATCACTTTAAGGTGATCCTGCCCTATGGCACACTGGTAATC

GACGGGGTTACGCCGAACATGCTGAACTATTTCGGACGGCCGTATGAAGG

CATCGCCGTGTTCGACGGCAAAAAGATCACTGTAACAGGGACCCTGTGGA

ACGGCGTCAAAATTATCGACGAGCGCCTGATCACCCCCGACGGCTCCATG

TCCTTCCGAGTAACCATCAACAGC
```

ATG-5491 K11Q Amino Acid
(SEQ ID NO: 606)
```
VFTLEDFVGDWQQTAAYNLDQVLEQGGVSSLLQNLAVSVTPIQRMVRSGE

NALKIDIHVIIPYEGLSADQMAQIEEVFKVVYPVDDHHFKVILPYGTLVI

DGVTPNMLNYFGRPYEGIAVFDGKKITVTGTLWNGVKIIDERLITPDGSM

SFRVTINS
```

ATG-5492 K11M Nucleotide
(SEQ ID NO: 607)
```
GTCTTCACACTCGAAGATTTCGTTGGGGACTGGATGCAGACAGCCGCCTA

CAACCTGGACCAAGTCCTTGAACAGGGAGGTGTGTCCAGTTTGCTGCAGA

ATCTCGCCGTGTCCGTAACTCCGATCCAAAGGATGGTCCGGAGCGGTGAA

AATGCCCTGAAGATCGACATCCATGTCATCATCCCGTATGAAGGTCTGAG

CGCCGACCAAATGGCCCAGATCGAAGAGGTGTTTAAGGTGGTGTACCCTG

TGGATGATCATCACTTTAAGGTGATCCTGCCCTATGGCACACTGGTAATC

GACGGGGTTACGCCGAACATGCTGAACTATTTCGGACGGCCGTATGAAGG

CATCGCCGTGTTCGACGGCAAAAAGATCACTGTAACAGGGACCCTGTGGA

ACGGCGTCAAAATTATCGACGAGCGCCTGATCACCCCCGACGGCTCCATG

TCCTTCCGAGTAACCATCAACAGC
```

ATG-5492 K11M Amino Acid
(SEQ ID NO: 608)
```
VFTLEDFVGDWMQTAAYNLDQVLEQGGVSSLLQNLAVSVTPIQRMVRSGE

NALKIDIHVIIPYEGLSADQMAQIEEVFKVVYPVDDHHFKVILPYGTLVI

DGVTPNMLNYFGRPYEGIAVFDGKKITVTGTLWNGVKIIDERLITPDGSM

SFRVTINS
```

ATG-5493 K11H Nucleotide
(SEQ ID NO: 609)
```
GTCTTCACACTCGAAGATTTCGTTGGGGACTGGCACCAGACAGCCGCCTA

CAACCTGGACCAAGTCCTTGAACAGGGAGGTGTGTCCAGTTTGCTGCAGA

ATCTCGCCGTGTCCGTAACTCCGATCCAAAGGATGGTCCGGAGCGGTGAA

AATGCCCTGAAGATCGACATCCATGTCATCATCCCGTATGAAGGTCTGAG

CGCCGACCAAATGGCCCAGATCGAAGAGGTGTTTAAGGTGGTGTACCCTG

TGGATGATCATCACTTTAAGGTGATCCTGCCCTATGGCACACTGGTAATC

GACGGGGTTACGCCGAACATGCTGAACTATTTCGGACGGCCGTATGAAGG
```

```
CATCGCCGTGTTCGACGGCAAAAAGATCACTGTAACAGGGACCCTGTGGA
ACGGCGTCAAAATTATCGACGAGCGCCTGATCACCCCCGACGGCTCCATG
TCCTTCCGAGTAACCATCAACAGC
```

ATG-5493 K11H Amino Acid
(SEQ ID NO: 610)
```
VFTLEDFVGDWHQTAAYNLDQVLEQGGVSSLLQNLAVSVTPIQRMVRSGE
NALKIDIHVIIPYEGLSADQMAQIEEVFKVVYPVDDHHFKVILPYGTLVI
DGVTPNMLNYFGRPYEGIAVFDGKKITVTGTLWNGVKIIDERLITPDGSM
SFRVTINS
```

ATG-5494 K11F Nucleotide
(SEQ ID NO: 611)
```
GTCTTCACACTCGAAGATTTCGTTGGGGACTGGTTCCAGACAGCCGCCTA
CAACCTGGACCAAGTCCTTGAACAGGGAGGTGTGTCCAGTTTGCTGCAGA
ATCTCGCCGTGTCCGTAACTCCGATCCAAAGGATGGTCCGGAGCGGTGAA
AATGCCCTGAAGATCGACATCCATGTCATCATCCCGTATGAAGGTCTGAG
CGCCGACCAAATGGCCCAGATCGAAGAGGTGTTTAAGGTGGTGTACCCTG
TGGATGATCATCACTTTAAGGTGATCCTGCCCTATGGCACACTGGTAATC
GACGGGGTTACGCCGAACATGCTGAACTATTTCGGACGGCCGTATGAAGG
CATCGCCGTGTTCGACGGCAAAAAGATCACTGTAACAGGGACCCTGTGGA
ACGGCGTCAAAATTATCGACGAGCGCCTGATCACCCCCGACGGCTCCATG
TCCTTCCGAGTAACCATCAACAGC
```

ATG-5494 K11F Amino Acid
(SEQ ID NO: 612)
```
VFTLEDFVGDWFQTAAYNLDQVLEQGGVSSLLQNLAVSVTPIQRMVRSGE
NALKIDIHVIIPYEGLSADQMAQIEEVFKVVYPVDDHHFKVILPYGTLVI
DGVTPNMLNYFGRPYEGIAVFDGKKITVTGTLWNGVKIIDERLITPDGSM
SFRVTINS
```

ATG-5495 K11W Nucleotide
(SEQ ID NO: 613)
```
GTCTTCACACTCGAAGATTTCGTTGGGGACTGGTGGCAGACAGCCGCCTA
CAACCTGGACCAAGTCCTTGAACAGGGAGGTGTGTCCAGTTTGCTGCAGA
ATCTCGCCGTGTCCGTAACTCCGATCCAAAGGATGGTCCGGAGCGGTGAA
AATGCCCTGAAGATCGACATCCATGTCATCATCCCGTATGAAGGTCTGAG
CGCCGACCAAATGGCCCAGATCGAAGAGGTGTTTAAGGTGGTGTACCCTG
TGGATGATCATCACTTTAAGGTGATCCTGCCCTATGGCACACTGGTAATC
GACGGGGTTACGCCGAACATGCTGAACTATTTCGGACGGCCGTATGAAGG
CATCGCCGTGTTCGACGGCAAAAAGATCACTGTAACAGGGACCCTGTGGA
ACGGCGTCAAAATTATCGACGAGCGCCTGATCACCCCCGACGGCTCCATG
TCCTTCCGAGTAACCATCAACAGC
```

ATG-5495 K11W Amino Acid
(SEQ ID NO: 614)
```
VFTLEDFVGDWWQTAAYNLDQVLEQGGVSSLLQNLAVSVTPIQRMVRSGE
NALKIDIHVIIPYEGLSADQMAQIEEVFKVVYPVDDHHFKVILPYGTLVI
DGVTPNMLNYFGRPYEGIAVFDGKKITVTGTLWNGVKIIDERLITPDGSM
SFRVTINS
```

ATG-5505 V135A + R152Q Nucleotide
(SEQ ID NO: 615)
```
GTCTTCACACTCGAAGATTTCGTTGGGGACTGGAAACAGACAGCCGCCTA
CAACCTGGACCAAGTCCTTGAACAGGGAGGTGTGTCCAGTTTGCTGCAGA
ATCTCGCCGTGTCCGTAACTCCGATCCAAAGGATGGTCCGGAGCGGTGAA
AATGCCCTGAAGATCGACATCCATGTCATCATCCCGTATGAAGGTCTGAG
CGCCGACCAAATGGCCCAGATAGAAGAGGTGTTTAAGGTGGTGTACCCTG
TGGATGATCATCACTTTAAGGTGATCCTGCCCTATGGCACACTGGTAATC
GACGGGGTTACGCCGAACATGCTGAACTATTTCGGACGGCCGTACGAAGG
CATCGCCGTGTTCGACGGCAAAAAGATCACTGTAACAGGGACCCTGTGGA
ACGGCGCCAAAATTATCGACGAGCGCCTGATCACCCCCGACGGCTCCATG
TCCTTCCAGGTAACCATCAACAGC
```

ATG-5505 V135A + R152Q Amino Acid
(SEQ ID NO: 616)
```
VFTLEDFVGDWKQTAAYNLDQVLEQGGVSSLLQNLAVSVTPIQRMVRSGE
NALKIDIHVIIPYEGLSADQMAQIEEVFKVVYPVDDHHFKVILPYGTLVI
DGVTPNMLNYFGRPYEGIAVFDGKKITVTGTLWNGAKIIDERLITPDGSM
SFQVTINS
```

ATG-5506 V135A + R152Q + N156D Nucleotide
(SEQ ID NO: 617)
```
GTCTTCACACTCGAAGATTTCGTTGGGGACTGGAAACAGACAGCCGCCTA
CAACCTGGACCAAGTCCTTGAACAGGGAGGTGTGTCCAGTTTGCTGCAGA
ATCTCGCCGTGTCCGTAACTCCGATCCAAAGGATGGTCCGGAGCGGTGAA
AATGCCCTGAAGATCGACATCCATGTCATCATCCCGTATGAAGGTCTGAG
CGCCGACCAAATGGCCCAGATAGAAGAGGTGTTTAAGGTGGTGTACCCTG
TGGATGATCATCACTTTAAGGTGATCCTGCCCTATGGCACACTGGTAATC
GACGGGGTTACGCCGAACATGCTGAACTATTTCGGACGGCCGTACGAAGG
CATCGCCGTGTTCGACGGCAAAAAGATCACTGTAACAGGGACCCTGTGGA
ACGGCGCCAAAATTATCGACGAGCGCCTGATCACCCCCGACGGCTCCATG
TCCTTCCAGGTAACCATCGACAGC
```

ATG-5506 V135A + R152Q + N156D Amino Acid
(SEQ ID NO: 618)
```
VFTLEDFVGDWKQTAAYNLDQVLEQGGVSSLLQNLAVSVTPIQRMVRSGE
NALKIDIHVIIPYEGLSADQMAQIEEVFKVVYPVDDHHFKVILPYGTLVI
DGVTPNMLNYFGRPYEGIAVFDGKKITVTGTLWNGAKIIDERLITPDGSM
SFQVTIDS
```

ATG-5507 P93H + V135A Nucleotide
(SEQ ID NO: 619)
```
GTCTTCACACTCGAAGATTTCGTTGGGGACTGGAAACAGACAGCCGCCTA
CAACCTGGACCAAGTCCTTGAACAGGGAGGTGTGTCCAGTTTGCTGCAGA
ATCTCGCCGTGTCCGTAACTCCGATCCAAAGGATGGTCCGGAGCGGTGAA
AATGCCCTGAAGATCGACATCCATGTCATCATCCCGTATGAAGGTCTGAG
CGCCGACCAAATGGCCCAGATAGAAGAGGTGTTTAAGGTGGTGTACCCTG
TGGATGATCATCACTTTAAGGTGATCCTGCACTATGGCACACTGGTAATC
GACGGGGTTACGCCGAACATGCTGAACTATTTCGGACGGCCGTACGAAGG
CATCGCCGTGTTCGACGGCAAAAAGATCACTGTAACAGGGACCCTGTGGA
```

-continued
ACGGCGCCAAAATTATCGACGAGCGCCTGATCACCCCCGACGGCTCCATG

TCCTTCCGAGTAACCATCAACAGC

ATG-5507 P93H + V135A Amino Acid
(SEQ ID NO: 620)
VFTLEDFVGDWKQTAAYNLDQVLEQGGVSSLLQNLAVSVTPIQRMVRSGE

NALKIDIHVIIPYEGLSADQMAQIEEVFKVVYPVDDHHFKVILHYGTLVI

DGVTPNMLNYFGRPYEGIAVFDGKKITVTGTLWNGAKIIDERLITPDGSM

SFRVTINS

ATG-5508 P93H + R152Q Nucleotide
(SEQ ID NO: 621)
GTCTTCACACTCGAAGATTTCGTTGGGGACTGGAAACAGACAGCCGCCTA

CAACCTGGACCAAGTCCTTGAACAGGGAGGTGTGTCCAGTTTGCTGCAGA

ATCTCGCCGTGTCCGTAACTCCGATCCAAAGGATGGTCCGGAGCGGTGAA

AATGCCCTGAAGATCGACATCCATGTCATCATCCCGTATGAAGGTCTGAG

CGCCGACCAAATGGCCCAGATCGAAGAGGTGTTTAAGGTGGTGTACCCTG

TGGATGATCATCACTTTAAGGTGATCCTGCACTATGGCACACTGGTAATC

GACGGGGTTACGCCGAACATGCTGAACTATTTCGGACGGCCGTATGAAGG

CATCGCCGTGTTCGACGGCAAAAAGATCACTGTAACAGGGACCCTGTGGA

ACGGCGTCAAAATTATCGACGAGCGCCTGATCACCCCCGACGGCTCCATG

TCCTTCCAGGTAACCATCAACAGC

ATG-5508 P93H + R152Q Amino Acid
(SEQ ID NO: 622)
VFTLEDFVGDWKQTAAYNLDQVLEQGGVSSLLQNLAVSVTPIQRMVRSGE

NALKIDIHVIIPYEGLSADQMAQIEEVFKVVYPVDDHHFKVILHYGTLVI

DGVTPNMLNYFGRPYEGIAVFDGKKITVTGTLWNGVKIIDERLITPDGSM

SFQVTINS

ATG-5509 P93H + R152Q + N156D Nucleotide
(SEQ ID NO: 623)
GTCTTCACACTCGAAGATTTCGTTGGGGACTGGAAACAGACAGCCGCCTA

CAACCTGGACCAAGTCCTTGAACAGGGAGGTGTGTCCAGTTTGCTGCAGA

ATCTCGCCGTGTCCGTAACTCCGATCCAAAGGATGGTCCGGAGCGGTGAA

AATGCCCTGAAGATCGACATCCATGTCATCATCCCGTATGAAGGTCTGAG

CGCCGACCAAATGGCCCAGATCGAAGAGGTGTTTAAGGTGGTGTACCCTG

TGGATGATCATCACTTTAAGGTGATCCTGCACTATGGCACACTGGTAATC

GACGGGGTTACGCCGAACATGCTGAACTATTTCGGACGGCCGTATGAAGG

CATCGCCGTGTTCGACGGCAAAAAGATCACTGTAACAGGGACCCTGTGGA

ACGGCGTCAAAATTATCGACGAGCGCCTGATCACCCCCGACGGCTCCATG

TCCTTCCAGGTAACCATCGACAGC

ATG-5509 P93H + R152Q + N156D Amino Acid
(SEQ ID NO: 624)
VFTLEDFVGDWKQTAAYNLDQVLEQGGVSSLLQNLAVSVTPIQRMVRSGE

NALKIDIHVIIPYEGLSADQMAQIEEVFKVVYPVDDHHFKVILHYGTLVI

DGVTPNMLNYFGRPYEGIAVFDGKKITVTGTLWNGVKIIDERLITPDGSM

SFQVTIDS

ATG-5510 P93H + V135A + R152Q Nucleotide
(SEQ ID NO: 625)
GTCTTCACACTCGAAGATTTCGTTGGGGACTGGAAACAGACAGCCGCCTA

CAACCTGGACCAAGTCCTTGAACAGGGAGGTGTGTCCAGTTTGCTGCAGA

ATCTCGCCGTGTCCGTAACTCCGATCCAAAGGATGGTCCGGAGCGGTGAA

AATGCCCTGAAGATCGACATCCATGTCATCATCCCGTATGAAGGTCTGAG

CGCCGACCAAATGGCCCAGATAGAAGAGGTGTTTAAGGTGGTGTACCCTG

TGGATGATCATCACTTTAAGGTGATCCTGCACTATGGCACACTGGTAATC

GACGGGGTTACGCCGAACATGCTGAACTATTTCGGACGGCCGTACGAAGG

CATCGCCGTGTTCGACGGCAAAAAGATCACTGTAACAGGGACCCTGTGGA

ACGGCGCCAAAATTATCGACGAGCGCCTGATCACCCCCGACGGCTCCATG

TCCTTCCAGGTAACCATCAACAGC

ATG-5510 P93H + V135A + R152Q Amino Acid
(SEQ ID NO: 626)
VFTLEDFVGDWKQTAAYNLDQVLEQGGVSSLLQNLAVSVTPIQRMVRSGE

NALKIDIHVIIPYEGLSADQMAQIEEVFKVVYPVDDHHFKVILHYGTLVI

DGVTPNMLNYFGRPYEGIAVFDGKKITVTGTLWNGAKIIDERLITPDGSM

SFQVTINS

ATG-5511 P93H + V135G + R152Q Nucleotide
(SEQ ID NO: 627)
GTCTTCACACTCGAAGATTTCGTTGGGGACTGGAAACAGACAGCCGCCTA

CAACCTGGACCAAGTCCTTGAACAGGGAGGTGTGTCCAGTTTGCTGCAGA

ATCTCGCCGTGTCCGTAACTCCGATCCAAAGGATGGTCCGGAGCGGTGAA

AATGCCCTGAAGATCGACATCCATGTCATCATCCCGTATGAAGGTCTGAG

CGCCGACCAAATGGCCCAGATAGAAGAGGTGTTTAAGGTGGTGTACCCTG

TGGATGATCATCACTTTAAGGTGATCCTGCACTATGGCACACTGGTAATC

GACGGGGTTACGCCGAACATGCTGAACTATTTCGGACGGCCGTACGAAGG

CATCGCCGTGTTCGACGGCAAAAAGATCACTGTAACAGGGACCCTGTGGA

ACGGCGGCAAAATTATCGACGAGCGCCTGATCACCCCCGACGGCTCCATG

TCCTTCCAGGTAACCATCAACAGC

ATG-5511 P93H + V135G + R152Q Amino Acid
(SEQ ID NO: 628)
VFTLEDFVGDWKQTAAYNLDQVLEQGGVSSLLQNLAVSVTPIQRMVRSGE

NALKIDIHVIIPYEGLSADQMAQIEEVFKVVYPVDDHHFKVILHYGTLVI

DGVTPNMLNYFGRPYEGIAVFDGKKITVTGTLWNGGKIIDERLITPDGSM

SFQVTINS

Mutations on 5344
ATG-5534 P93H + V135A + R152Q (codon optimized 5510) Nucleotide
(SEQ ID NO: 629)
TTCACTTTGGAAGATTTCGTGGGTGACTGGAAACAGACTGCAGCATACAA

CTTAGACCAAGTGTTGGAACAGGGTGGAGTTAGTTCGCTTTTACAGAATT

TGGCAGTTAGTGTTACGCCTATACAACGTATGGTGAGATCGGGAGAAAAT

GCATTAAAAATAGACATACATGTGATAATACCTTATGAAGGATTATCGGC

AGACCAAATGGCACAGATAGAAGAGGTTTTTAAAGTTGTTTACCCAGTTG

ATGATCATCACTTTAAAGTTATATTACACTATGGAACTTTAGTTATAGAC

GGTGTGACTCCTAACATGTTAAACTATTTCGGTAGACCTTATGAAGGAAT

AGCAGTTTTCGACGGAAAGAAAATAACGGTTACTGGTACGTTATGGAACG

GAGCCAAGATAATAGACGAGAGATTAATAACGCCAGACGGAAGTATGAGT

TTCCAGGTTACGATaaactcg

ATG-5534 P93H + V135A + R152Q (codon optimized 5510) Amino Acid
(SEQ ID NO: 630)
FTLEDFVGDWKQTAAYNLDQVLEQGGVSSLLQNLAVSVTPIQRMVRSGEN

ALKIDIHVIIPYEGLSADQMAQIEEVFKVVYPVDDHHFKVILHYGTLVID

GVTPNMLNYFGRPYEGIAVFDGKKITVTGTLWNGAKIIDERLITPDGSMS

FQVTINS

ATG-5535 P93H + V135A + R152Q + N156D Nucleotide
(SEQ ID NO: 631)
TTCACTTTGGAAGATTTCGTGGGTGACTGGAAACAGACTGCAGCATACAA

CTTAGACCAAGTGTTGGAACAGGGTGGAGTTAGTTCGCTTTTACAGAATT

TGGCAGTTAGTGTTACGCCTATACAACGTATGGTGAGATCGGGAGAAAAT

GCATTAAAAATAGACATACATGTGATAATACCTTATGAAGGATTATCGGC

AGACCAAATGGCACAGATAGAAGAGGTTTTTAAAGTTGTTTACCCAGTTG

ATGATCATCACTTTAAAGTTATATTACACTATGGAACTTTAGTTATAGAC

GGTGTGACTCCTAACATGTTAAACTATTTCGGTAGACCTTATGAAGGAAT

AGCAGTTTTCGACGGAAAGAAAATAACGGTTACTGGTACGTTATGGAACG

GAGCCAAGATAATAGACGAGAGATTAATAACGCCAGACGGAAGTATGAGT

TTCCAGGTTACGATAGACTCG

ATG-5535 P93H + V135A + R152Q + N156D Amino Acid
(SEQ ID NO: 632)
FTLEDFVGDWKQTAAYNLDQVLEQGGVSSLLQNLAVSVTPIQRMVRSGEN

ALKIDIHVIIPYEGLSADQMAQIEEVFKVVYPVDDHHFKVILHYGTLVID

GVTPNMLNYFGRPYEGIAVFDGKKITVTGTLWNGAKIIDERLITPDGSMS

FQVTID

ATG-5536 E4D + V135A + R152Q Nucleotide
(SEQ ID NO: 633)
TTCACTTTGGACGATTTCGTGGGTGACTGGAAACAGACTGCAGCATACAA

CTTAGACCAAGTGTTGGAACAGGGTGGAGTTAGTTCGCTTTTACAGAATT

TGGCAGTTAGTGTTACGCCTATACAACGTATGGTGAGATCGGGAGAAAAT

GCATTAAAAATAGACATACATGTGATAATACCTTATGAAGGATTATCGGC

AGACCAAATGGCACAGATAGAAGAGGTTTTTAAAGTTGTTTACCCAGTTG

ATGATCATCACTTTAAAGTTATATTACCATATGGAACTTTAGTTATAGAC

GGTGTGACTCCTAACATGTTAAACTATTTCGGTAGACCTTATGAAGGAAT

AGCAGTTTTCGACGGAAAGAAAATAACGGTTACTGGTACGTTATGGAACG

GAGCCAAGATAATAGACGAGAGATTAATAACGCCAGACGGAAGTATGAGT

TTCCAGGTTACGATAAACTCG

ATG-5536 E4D + V135A + R152Q Amino Acid
(SEQ ID NO: 634)
FTLDDFVGDWKQTAAYNLDQVLEQGGVSSLLQNLAVSVTPIQRMVRSGEN

ALKIDIHVIIPYEGLSADQMAQIEEVFKVVYPVDDHHFKVILPYGTLVID

GVTPNMLNYFGRPYEGIAVFDGKKITVTGTLWNGAKIIDERLITPDGSMS

FQVTINS

ATG-5537 E4D + Q42M + P93H + V135A + R152Q Nucleotide
(SEQ ID NO: 635)
TTCACTTTGGACGATTTCGTGGGTGACTGGAAACAGACTGCAGCATACAA

CTTAGACCAAGTGTTGGAACAGGGTGGAGTTAGTTCGCTTTTACAGAATT

TGGCAGTTAGTGTTACGCCTATAATGCGTATGGTGAGATCGGGAGAAAAT

GCATTAAAAATAGACATACATGTGATAATACCTTATGAAGGATTATCGGC

AGACCAAATGGCACAGATAGAAGAGGTTTTTAAAGTTGTTTACCCAGTTG

ATGATCATCACTTTAAAGTTATATTACACTATGGAACTTTAGTTATAGAC

GGTGTGACTCCTAACATGTTAAACTATTTCGGTAGACCTTATGAAGGAAT

AGCAGTTTTCGACGGAAAGAAAATAACGGTTACTGGTACGTTATGGAACG

GAGCCAAGATAATAGACGAGAGATTAATAACGCCAGACGGAAGTATGAGT

TTCCAGGTTACGATAAACTCGT

ATG-5537 E4D + Q42M + P93H + V135A + R152Q Amino Acid
(SEQ ID NO: 636)
FTLDDFVGDWKQTAAYNLDQVLEQGGVSSLLQNLAVSVTPIMRMVRSGEN

ALKIDIHVIIPYEGLSADQMAQIEEVFKVVYPVDDHHFKVILHYGTLVID

GVTPNMLNYFGRPYEGIAVFDGKKITVTGTLWNGAKIIDERLITPDGSMS

FQVTINS

Mutations on 5534
ATG-5652 5534 + Y16F Q20P Q152H Nucleotide
(SEQ ID NO: 637)
TTCACTTTGGAAGATTTCGTGGGTGACTGGAAACAGACTGCAGCATTCAA

CTTAGACCCAGTGTTGGAACAGGGTGGAGTTAGTTCGCTTTTACAGAATT

TGGCAGTTAGTGTTACGCCTATACAACGTATGGTGAGATCGGGAGAAAAT

GCATTAAAAATAGACATACATGTGATAATACCTTATGAAGGATTATCGGC

AGACCAAATGGCACAGATAGAAGAGGTTTTTAAAGTTGTTTACCCAGTTG

ATGATCATCACTTTAAAGTTATATTACACTATGGAACTTTAGTTATAGAC

GGTGTGACTCCTAACATGTTAAACTATTTCGGTAGACCTTATGAAGGAAT

AGCAGTTTTCGACGGAAAGAAAATAACGGTTACTGGTACGCTATGGAACG

GAGCCAAGATAATAGACGAGAGATTAATAACGCCAGACGGAAGTATGAGT

TTCCACGTTACGATAAACTCG

ATG-5652 5534 + Y16F Q20P Q152H Amino Acid
(SEQ ID NO: 638)
FTLEDFVGDWKQTAAFNLDPVLEQGGVSSLLQNLAVSVTPIQRMVRSGEN

ALKIDIHVIIPYEGLSADQMAQIEEVFKVVYPVDDHHFKVILHYGTLVID

GVTPNMLNYFGRPYEGIAVFDGKKITVTGTLWNGAKIIDERLITPDGSMS

FHVTINS

ATG-5653 5534 + M106R, Y114F, E4E Nucleotide
(SEQ ID NO: 639)
TTCACTTTGGAGGATTTCGTGGGTGACTGGAAACAGACTGCAGCATACAA

CTTAGACCAAGTGTTGGAACAGGGTGGAGTTAGTTCGCTTTTACAGAATT

TGGCAGTTAGTGTTACGCCTATACAACGTATGGTGAGATCGGGAGAAAAT

GCATTAAAAATAGACATACATGTGATAATACCTTATGAAGGATTATCGGC

AGACCAAATGGCACAGATAGAAGAGGTTTTTAAAGTTGTTTACCCAGTTG

ATGATCATCACTTTAAAGTTATATTACACTATGGAACTTTAGTTATAGAC

GGTGTGACTCCTAACAGGTTAAACTATTTCGGTAGACCTTTTGAAGGAAT

ATG-5653 5534 + M106R, Y114F, E4E Amino Acid
(SEQ ID NO: 640)
FTLEDFVGDWKQTAAYNLDQVLEQGGVSSLLQNLAVSVTPIQRMVRSGEN
ALKIDIHVIIPYEGLSADQMAQIEEVFKVVYPVDDHHFKVILHYGTLVID
GVTPNRLNYFGRPFEGIAVFDGKKITVTGTLWNGAKIIDERLITPDGSMS
FQVTINS ATG-5654 5534 + M44V Nucleotide
(SEQ ID NO: 641)
TTCACTTTGGAAGATTTCGTGGGTGACTGGAAACAGACTGCAGCATACAA
CTTAGACCAAGTGTTGGAACAGGGTGGAGTTAGTTCGCTTTTACAGAATT
TGGCAGTTAGTGTTACGCCTATACAACGTGTGGTGAGATCGGGAGAAAAT
GCATTAAAAATAGACATACATGTGATAATACCTTATGAAGGATTATCGGC
AGACCAAATGGCACAGATAGAAGAGGTTTTTAAAGTTGTTTACCCAGTTG
ATGATCATCACTTTAAAGTTATATTACACTATGGAACTTTAGTTATAGAC
GGTGTGACTCCTAACATGTTAAACTATTTCGGTAGACCTTATGAAGGAAT
AGCAGTTTTCGACGGAAAGAAAATAACGGTTACAGGTACGTTATGGAACG
GAGCCAAGATAATAGACGAGAGATTAATAACGCCAGACGGAAGTATGAGT
TTCCAGGTTACGATAAACTCG ATG-5654 5534 + M44V (amino acid)
(SEQ ID NO: 642)
FTLEDFVGDWKQTAAYNLDQVLEQGGVSSLLQNLAVSVTPIQRVVRSGEN
ALKIDIHVIIPYEGLSADQMAQIEEVFKVVYPVDDHHFKVILHYGTLVID
GVTPNMLNYFGRPYEGIAVFDGKKITVTGTLWNGAKIIDERLITPDGSMS
FQVTINS ATG-5655 5534 + M44I Nucleotide
(SEQ ID NO: 643)
TTCACTTTGGAAGATTTCGTGGGTGACTGGAAACAGACTGCAGCATACAA
CTTAGACCAAGTGTTGGAACAGGGTGGAGTTAGTTCGCTTTTACAGAATT
TGGCAGTTAGTGTTACGCCTATACAACGTATAGTGAGATCGGGAGAAAAT
GCATTAAAAATAGACATACATGTGATAATACCTTATGAAGGATTATCGGC
AGACCAAATGGCACAGATAGAAGAGGTTTTTAAAGTTGTTTACCCAGTTG
ATGATCATCACTTTAAAGTTATATTACACTATGGAACTTTAGTTATAGAC
GGTGTGACTCCTAACATGTTAAACTATTTCGGTAGACCTTATGAAGGAAT
AGCAGTTTTCGACGGAAAGAAAATAACGGTTACTGGTACGTTATGGAACG
GAGCCAAGATAATAGACGAGAGATTAATAACGCCAGACGGAAGTATGAGT
TTCCAGGTTACGATAAACTCG ATG-5655 5534 + M44I Amino Acid
(SEQ ID NO: 644)
FTLEDFVGDWKQTAAYNLDQVLEQGGVSSLLQNLAVSVTPIQRIVRSGEN
ALKIDIHVIIPYEGLSADQMAQIEEVFKVVYPVDDHHFKVILHYGTLVID
GVTPNMLNYFGRPYEGIAVFDGKKITVTGTLWNGAKIIDERLITPDGSMS
FQVTINS ATG-5656 5534 + A35A, P40P, M106R Nucleotide
(SEQ ID NO: 645)
TTCACTTTGGAAGATTTCGTGGGTGACTGGAAACAGACTGCAGCATACAA
CTTAGACCAAGTGTTGGAACAGGGTGGAGTTAGTTCGCTTTTACAGAATT
TGGCTGTTAGTGTTACGCCAATACAACGTATGGTGAGATCGGGAGAAAAT
GCATTAAAAATAGACATACATGTGATAATACCTTATGAAGGATTATCGGC
AGACCAAATGGCACAGATAGAAGAGGTTTTTAAAGTTGTTTACCCAGTTG
ATGATCATCACTTTAAAGTTATATTACACTATGGAACTTTAGTTATAGAC
GGTGTGACTCCTAACAGGTTAAACTATTTCGGTAGACCTTATGAAGGAAT
AGCAGTTTTCGACGGAAAGAAAATAACGGTTACTGGTACGTTATGGAACG
GAGCCAAGATAATAGACGAGAGATTAATAACGCCAGACGGAAGTATGAGT
TTCCAGGTTACGATAAACTCG ATG-5656 5534 + A35A, P40P, M106R amino acid
(SEQ ID NO: 646)
FTLEDFVGDWKQTAAYNLDQVLEQGGVSSLLQNLAVSVTPIQRMVRSGEN
ALKIDIHVIIPYEGLSADQMAQIEEVFKVVYPVDDHHFKVILHYGTLVID
GVTPNRLNYFGRPYEGIAVFDGKKITVTGTLWNGAKIIDERLITPDGSMS
FQVTINS ATG-5657 5534 + M106T Nucleotide
(SEQ ID NO: 647)
TTCACTTTGGAAGATTTCGTGGGTGACTGGAAACAGACTGCAGCATACAA
CTTAGACCAAGTGTTGGAACAGGGTGGAGTTAGTTCGCTTTTACAGAATT
TGGCAGTTAGTGTTACGCCTATACAACGTATGGTGAGATCGGGAGAAAAT
GCATTAAAAATAGACATACATGTGATAATACCTTATGAAGGATTATCGGC
AGACCAAATGGCACAGATAGAAGAGGTTTTTAAAGTTGTTTACCCAGTTG
ATGATCATCACTTTAAAGTTATATTACACTATGGAACTTTAGTTATAGAC
GGTGTGACTCCTAACACGTTAAACTATTTCGGTAGACCTTATGAAGGAAT
AGCAGTTTTCGACGGAAAGAAAATAACGGTTACTGGTACGTTATGGAACG
GAGCCAAGATAATAGACGAGAGATTAATAACGCCAGACGGAAGTATGAGT
TTCCAGGTTACGATAAACTCG ATG-5657 5534 + M106T amino acid
(SEQ ID NO: 648)
FTLEDFVGDWKQTAAYNLDQVLEQGGVSSLLQNLAVSVTPIQRMVRSGEN
ALKIDIHVIIPYEGLSADQMAQIEEVFKVVYPVDDHHFKVILHYGTLVID
GVTPNTLNYFGRPYEGIAVFDGKKITVTGTLWNGAKIIDERLITPDGSMS
FQVTINS ATG-5659 5534 + M106K + L30L + K136E Nucleotide
(SEQ ID NO: 649)
TTCACTTTGGAAGATTTCGTGGGTGACTGGAAACAGACTGCAGCATACAA
CTTAGACCAAGTGTTGGAACAGGGTGGAGTTAGTTCGCTGTTACAGAATT
TGGCAGTTAGTGTTACGCCTATACAACGTATGGTGAGATCGGGAGAAAAT
GCATTAAAAATAGACATACATGTGATAATACCTTATGAAGGATTATCGGC
AGACCAAATGGCACAGATAGAAGAGGTTTTTAAAGTTGTTTACCCAGTTG
ATGATCATCACTTTAAAGTTATATTACACTATGGAACTTTAGTTATAGAC
GGTGTGACTCCTAACAAGTTAAACTATTTCGGTAGACCTTATGAAGGAAT
AGCAGTTTTCGACGGAAAGAAAATAACGGTTACTGGTACGTTATGGAACG

GAGCCGAGATAATAGACGAGAGATTAATAACGCCAGACGGAAGTATGAGT

TTCCAGGTTACGATAAACTCG

ATG-5659 5534 + M106K + L30L + K136E amino acid
(SEQ ID NO: 650)
FTLEDFVGDWKQTAAYNLDQVLEQGGVSSLLQNLAVSVTPIQRMVRSGEN

ALKIDIHVIIPYEGLSADQMAQIEEVFKVVYPVDDHHFKVILHYGTLVID

GVTPNKLNYFGRPYEGIAVFDGKKITVTGTLWNGAEIIDERLITPDGSMS

FQVTINS

ATG-5660 5534 + V36G, N50N, A14A Nucleotide
(SEQ ID NO: 651)
TTCACTTTGGAAGATTTCGTGGGTGACTGGAAACAGACTGCGGCATACAA

CTTAGACCAAGTGTTGGAACAGGGTGGAGTTAGTTCGCTTTTACAGAATT

TGGCAGGTAGTGTTACGCCTATACAACGTATGGTGAGATCGGGAGAAAAC

GCATTAAAAATAGACATACATGTGATAATACCTTATGAAGGATTATCGGC

AGACCAAATGGCACAGATAGAAGAGGTTTTTAAAGTTGTTTACCCAGTTG

ATGATCATCACTTTAAAGTTATATTCACTATGGAACTTTAGTTATAGAC

GGTGTGACTCCTAACATGTTAAACTATTTCGGTAGACCTTATGAAGGAAT

AGCAGTTTTCGACGGAAAGAAAATAACGGTTACTGGTACGTTATGGAACG

GAGCCAAGATAATAGACGAGAGATTAATAACGCCAGACGGAAGTATGAGT

TTCCAGGTTACGATAAACTCG

ATG-5660 5534 + V36G, N50N, A14A amino acid
(SEQ ID NO: 652)
FTLEDFVGDWKQTAAYNLDQVLEQGGVSSLLQNLAGSVTPIQRMVRSGEN

ALKIDIHVIIPYEGLSADQMAQIEEVFKVVYPVDDHHFKVILHYGTLVID

GVTPNMLNYFGRPYEGIAVFDGKKITVTGTLWNGAKIIDERLITPDGSMS

FQVTINS

ATG-5661 5534 + A15A, A67A, M106L, L107L, I138K Nucleotide
(SEQ ID NO: 653)
TTCACTTTGGAAGATTTCGTGGGTGACTGGAAACAGACTGCAGCGTACAA

CTTAGACCAAGTGTTGGAACAGGGTGGAGTTAGTTCGCTTTTACAGAATT

TGGCAGTTAGTGTTACGCCTATACAACGTATGGTGAGATCGGGAGAAAAT

GCATTAAAAATAGACATACATGTGATAATACCTTATGAAGGATTATCGGC

TGACCAAATGGCACAGATAGAAGAGGTTTTTAAAGTTGTTTACCCAGTTG

ATGATCATCACTTTAAAGTTATATTACACTATGGAACTTTAGTTATAGAC

GGTGTGACTCCTAACTTGTTGAACTATTTCGGTAGACCTTATGAAGGAAT

AGCAGTTTTCGACGGAAAGAAAATAACGGTTACTGGTACGTTATGGAACG

GAGCCAAGATAAAAGACGAGAGATTAATAACGCCAGACGGAAGTATGAGT

TTCCAGGTTACGATAAACTCG

ATG-5661 5534 + A15A, A67A, M106L, L107L, I138K amino acid
(SEQ ID NO: 654)
FTLEDFVGDWKQTAAYNLDQVLEQGGVSSLLQNLAVSVTPIQRMVRSGEN

ALKIDIHVIIPYEGLSADQMAQIEEVFKVVYPVDDHHFKVILHYGTLVID

GVTPNLLNYFGRPYEGIAVFDGKKITVTGTLWNGAKIKDERLITPDGSMS

FQVTINS

ATG-5662 5534 + D5G, A35T, L92F, D100V, R141G,

L1142S Nucleotide
(SEQ ID NO: 655)
TTCACTTTGGAAGGTTTCGTGGGTGACTGGAAACAGACTGCAGCATACAA

CTTAGACCAAGTGTTGGAACAGGGTGGAGTTAGTTCGCTTTTACAGAATT

TGACAGTTAGTGTTACGCCTATACAACGTATGGTGAGATCGGGAGAAAAT

GCATTAAAAATAGACATACATGTGATAATACCTTATGAAGGATTATCGGC

AGACCAAATGGCACAGATAGAAGAGGTTTTTAAAGTTGTTTACCCAGTTG

ATGATCATCACTTTAAAGTTATATTTCACTATGGAACTTTAGTTATAGTC

GGTGTGACTCCTAACATGTTAAACTATTTCGGTAGACCTTATGAAGGAAT

AGCAGTTTTCGACGGAAAGAAAATAACGGTTACTGGTACGTTATGGAACG

GAGCCAAGATAATAGACGAGGGATCAATAACGCCAGACGGAAGTATGAGT

TTCCAGGTTACGATAAACTCG

ATG-5662 5534 + D5G, A35T, L92F, D100V, R141G, L1142S amino acid
(SEQ ID NO: 656)
FTLEGFVGDWKQTAAYNLDQVLEQGGVSSLLQNLTVSVTPIQRMVRSGEN

ALKIDIHVIIPYEGLSADQMAQIEEVFKVVYPVDDHHFKVIFHYGTLVIV

GVTPNMLNYFGRPYEGIAVFDGKKITVTGTLWNGAKIIDEGSITPDGSMS

FQVTINS

ATG-5676 5534 + M44K Nucleotide
(SEQ ID NO: 657)
TTCACTTTGGAAGATTTCGTGGGTGACTGGAAACAGACTGCAGCATACAA

CTTAGACCAAGTGTTGGAACAGGGTGGAGTTAGTTCGCTTTTACAGAATT

TGGCAGTTAGTGTTACGCCTATACAACGTAAGGTGAGATCGGGAGAAAAT

GCATTAAAAATAGACATACATGTGATAATACCTTATGAAGGATTATCGGC

AGACCAAATGGCACAGATAGAAGAGGTTTTTAAAGTTGTTTACCCAGTTG

ATGATCATCACTTTAAAGTTATATTACACTATGGAACTTTAGTTATAGAC

GGTGTGACTCCTAACATGTTAAACTATTTCGGTAGACCTTATGAAGGAAT

AGCAGTTTTCGACGGAAAGAAAATAACGGTTACTGGTACGTTATGGAACG

GAGCCAAGATAATAGACGAGAGATTAATAACGCCAGACGGAAGTATGAGT

TTCCAGGTTACGAtaaactcg

ATG-5676 5534 + M44K amino acid
(SEQ ID NO: 658)
FTLEDFVGDWKQTAAYNLDQVLEQGGVSSLLQNLAVSVTPIQRKVRSGEN

ALKIDIHVIIPYEGLSADQMAQIEEVFKVVYPVDDHHFKVILHYGTLVID

GVTPNMLNYFGRPYEGIAVFDGKKITVTGTLWNGAKIIDERLITPDGSMS

FQVTINS

ATG-5677 5534 + M44E Nucleotide
(SEQ ID NO: 659)
TTCACTTTGGAAGATTTCGTGGGTGACTGGAAACAGACTGCAGCATACAA

CTTAGACCAAGTGTTGGAACAGGGTGGAGTTAGTTCGCTTTTACAGAATT

TGGCAGTTAGTGTTACGCCTATACAACGTGAGGTGAGATCGGGAGAAAAT

GCATTAAAAATAGACATACATGTGATAATACCTTATGAAGGATTATCGGC

AGACCAAATGGCACAGATAGAAGAGGTTTTTAAAGTTGTTTACCCAGTTG

ATGATCATCACTTTAAAGTTATATTACACTATGGAACTTTAGTTATAGAC

GGTGTGACTCCTAACATGTTAAACTATTTCGGTAGACCTTATGAAGGAAT

```
AGCAGTTTTCGACGGAAAGAAAATAACGGTTACTGGTACGTTATGGAACG
GAGCCAAGATAATAGACGAGAGATTAATAACGCCAGACGGAAGTATGAGT
TTCCAGGTTACGATAAACTCG
```

ATG-5677 5534 + M44E amino acid
(SEQ ID NO: 660)
```
FTLEDFVGDWKQTAAYNLDQVLEQGGVSSLLQNLAVSVTPIQREVRSGEN
ALKIDIHVIIPYEGLSADQMAQIEEVFKVVYPVDDHHFKVILHYGTLVID
GVTPNMLNYFGRPYEGIAVFDGKKITVTGTLWNGAKIIDERLITPDGSMS
FQVTINS
```

ATG-5678 5534 + M44A Nucleotide
(SEQ ID NO: 661)
```
TTCACTTTGGAAGATTTCGTGGGTGACTGGAAACAGACTGCAGCATACAA
CTTAGACCAAGTGTTGGAACAGGGTGGAGTTAGTTCGCTTTTACAGAATT
TGGCAGTTAGTGTTACGCCTATACAACGTGCGGTGAGATCGGGAGAAAAT
GCATTAAAAATAGACATACATGTGATAATACCTTATGAAGGATTATCGGC
AGACCAAATGGCACAGATAGAAGAGGTTTTTAAAGTTGTTTACCCAGTTG
ATGATCATCACTTTAAAGTTATATTACACTATGGAACTTTAGTTATAGAC
GGTGTGACTCCTAACATGTTAAACTATTTCGGTAGACCTTATGAAGGAAT
AGCAGTTTTCGACGGAAAGAAAATAACGGTTACTGGTACGTTATGGAACG
GAGCCAAGATAATAGACGAGAGATTAATAACGCCAGACGGAAGTATGAGT
TTCCAGGTTACGATAAACTCG
```

ATG-5678 5534 + M44A amino acid
(SEQ ID NO: 662)
```
FTLEDFVGDWKQTAAYNLDQVLEQGGVSSLLQNLAVSVTPIQRAVRSGEN
ALKIDIHVIIPYEGLSADQMAQIEEVFKVVYPVDDHHFKVILHYGTLVID
GVTPNMLNYFGRPYEGIAVFDGKKITVTGTLWNGAKIIDERLITPDGSMS
FQVTINS
```

ATG-5679 M44C Nucleotide
(SEQ ID NO: 663)
```
TTCACTTTGGAAGATTTCGTGGGTGACTGGAAACAGACTGCAGCATACAA
CTTAGACCAAGTGTTGGAACAGGGTGGAGTTAGTTCGCTTTTACAGAATT
TGGCAGTTAGTGTTACGCCTATACAACGTTGTGTGAGATCGGGAGAAAAT
GCATTAAAAATAGACATACATGTGATAATACCTTATGAAGGATTATCGGC
AGACCAAATGGCACAGATAGAAGAGGTTTTTAAAGTTGTTTACCCAGTTG
ATGATCATCACTTTAAAGTTATATTACACTATGGAACTTTAGTTATAGAC
GGTGTGACTCCTAACATGTTAAACTATTTCGGTAGACCTTATGAAGGAAT
AGCAGTTTTCGACGGAAAGAAAATAACGGTTACTGGTACGTTATGGAACG
GAGCCAAGATAATAGACGAGAGATTAATAACGCCAGACGGAAGTATGAGT
TTCCAGGTTACGATAAACTCG
```

ATG-5679 M44C amino acid
(SEQ ID NO: 664)
```
FTLEDFVGDWKQTAAYNLDQVLEQGGVSSLLQNLAVSVTPIQRCVRSGEN
ALKIDIHVIIPYEGLSADQMAQIEEVFKVVYPVDDHHFKVILHYGTLVID
GVTPNMLNYFGRPYEGIAVFDGKKITVTGTLWNGAKIIDERLITPDGSMS
FQVTINS
```

ATG-5680 M44W Nucleotide
(SEQ ID NO: 665)
```
TTCACTTTGGAAGATTTCGTGGGTGACTGGAAACAGACTGCAGCATACAA
CTTAGACCAAGTGTTGGAACAGGGTGGAGTTAGTTCGCTTTTACAGAATT
TGGCAGTTAGTGTTACGCCTATACAACGTTGGGTGAGATCGGGAGAAAAT
GCATTAAAAATAGACATACATGTGATAATACCTTATGAAGGATTATCGGC
AGACCAAATGGCACAGATAGAAGAGGTTTTTAAAGTTGTTTACCCAGTTG
ATGATCATCACTTTAAAGTTATATTACACTATGGAACTTTAGTTATAGAC
GGTGTGACTCCTAACATGTTAAACTATTTCGGTAGACCTTATGAAGGAAT
AGCAGTTTTCGACGGAAAGAAAATAACGGTTACTGGTACGTTATGGAACG
GAGCCAAGATAATAGACGAGAGATTAATAACGCCAGACGGAAGTATGAGT
TTCCAGGTTACGATAAACTCGT
```

ATG-5680 M44W amino acid
(SEQ ID NO: 666)
```
FTLEDFVGDWKQTAAYNLDQVLEQGGVSSLLQNLAVSVTPIQRWVRSGEN
ALKIDIHVIIPYEGLSADQMAQIEEVFKVVYPVDDHHFKVILHYGTLVID
GVTPNMLNYFGRPYEGIAVFDGKKITVTGTLWNGAKIIDERLITPDGSMS
FQVTINS
```

ATG-5681 M44G Nucleotide
(SEQ ID NO: 667)
```
TTCACTTTGGAAGATTTCGTGGGTGACTGGAAACAGACTGCAGCATACAA
CTTAGACCAAGTGTTGGAACAGGGTGGAGTTAGTTCGCTTTTACAGAATT
TGGCAGTTAGTGTTACGCCTATACAACGTGGGGTGAGATCGGGAGAAAAT
GCATTAAAAATAGACATACATGTGATAATACCTTATGAAGGATTATCGGC
AGACCAAATGGCACAGATAGAAGAGGTTTTTAAAGTTGTTTACCCAGTTG
ATGATCATCACTTTAAAGTTATATTACACTATGGAACTTTAGTTATAGAC
GGTGTGACTCCTAACATGTTAAACTATTTCGGTAGACCTTATGAAGGAAT
AGCAGTTTTCGACGGAAAGAAAATAACGGTTACTGGTACGTTATGGAACG
GAGCCAAGATAATAGACGAGAGATTAATAACGCCAGACGGAAGTATGAGT
TTCCAGGTTACGATAAACTCG
```

ATG-5681 M44G amino acid
(SEQ ID NO: 668)
```
FTLEDFVGDWKQTAAYNLDQVLEQGGVSSLLQNLAVSVTPIQRGVRSGEN
ALKIDIHVIIPYEGLSADQMAQIEEVFKVVYPVDDHHFKVILHYGTLVID
GVTPNMLNYFGRPYEGIAVFDGKKITVTGTLWNGAKIIDERLITPDGSMS
FQVTINS
```

ATG-5682 M44H Nucleotide
(SEQ ID NO: 669)
```
TTCACTTTGGAAGATTTCGTGGGTGACTGGAAACAGACTGCAGCATACAA
CTTAGACCAAGTGTTGGAACAGGGTGGAGTTAGTTCGCTTTTACAGAATT
TGGCAGTTAGTGTTACGCCTATACAACGTCATGTGAGATCGGGAGAAAAT
GCATTAAAAATAGACATACATGTGATAATACCTTATGAAGGATTATCGGC
AGACCAAATGGCACAGATAGAAGAGGTTTTTAAAGTTGTTTACCCAGTTG
ATGATCATCACTTTAAAGTTATATTACACTATGGAACTTTAGTTATAGAC
GGTGTGACTCCTAACATGTTAAACTATTTCGGTAGACCTTATGAAGGAAT
AGCAGTTTTCGACGGAAAGAAAATAACGGTTACTGGTACGTTATGGAACG
```

```
GAGCCAAGATAATAGACGAGAGATTAATAACGCCAGACGGAAGTATGAGT
TTCCAGGTTACGATAAACTCG

ATG-5682 M44H amino acid
                                         (SEQ ID NO: 670)
FTLEDFVGDWKQTAAYNLDQVLEQGGVSSLLQNLAVSVTPIQRHVRSGEN
ALKIDIHVIIPYEGLSADQMAQIEEVFKVVYPVDDHHFKVILHYGTLVID
GVTPNMLNYFGRPYEGIAVFDGKKITVTGTLWNGAKIIDERLITPDGSMS
FQVTINS ATG-5683 M44S Nucleotide
                                         (SEQ ID NO: 671)
TTCACTTTGGAAGATTTCGTGGGTGACTGGAAACAGACTGCAGCATACAA
CTTAGACCAAGTGTTGGAACAGGGTGGAGTTAGTTCGCTTTTACAGAATT
TGGCAGTTAGTGTTACGCCTATACAACGTAGTGTGAGATCGGGAGAAAAT
GCATTAAAAATAGACATACATGTGATAATACCTTATGAAGGATTATCGGC
AGACCAAATGGCACAGATAGAAGAGGTTTTTAAAGTTGTTTACCCAGTTG
ATGATCATCACTTTAAAGTTATATTACACTATGGAACTTTAGTTATAGAC
GGTGTGACTCCTAACATGTTAAACTATTTCGGTAGACCTTATGAAGGAAT
AGCAGTTTTCGACGGAAAGAAAATAACGGTTACTGGTACGTTATGGAACG
GAGCCAAGATAATAGACGAGAGATTAATAACGCCAGACGGAAGTATGAGT
TTCCAGGTTACGATAAACTCG ATG-5683 M44S amino acid
                                         (SEQ ID NO: 672)
FTLEDFVGDWKQTAAYNLDQVLEQGGVSSLLQNLAVSVTPIQRSVRSGEN
ALKIDIHVIIPYEGLSADQMAQIEEVFKVVYPVDDHHFKVILHYGTLVID
GVTPNMLNYFGRPYEGIAVFDGKKITVTGTLWNGAKIIDERLITPDGSMS
FQVTINS ATG-5684 M44Q Nucleotide
                                         (SEQ ID NO: 673)
TTCACTTTGGAAGATTTCGTGGGTGACTGGAAACAGACTGCAGCATACAA
CTTAGACCAAGTGTTGGAACAGGGTGGAGTTAGTTCGCTTTTACAGAATT
TGGCAGTTAGTGTTACGCCTATACAACGTCAGGTGAGATCGGGAGAAAAT
GCATTAAAAATAGACATACATGTGATAATACCTTATGAAGGATTATCGGC
AGACCAAATGGCACAGATAGAAGAGGTTTTTAAAGTTGTTTACCCAGTTG
ATGATCATCACTTTAAAGTTATATTACACTATGGAACTTTAGTTATAGAC
GGTGTGACTCCTAACATGTTAAACTATTTCGGTAGACCTTATGAAGGAAT
AGCAGTTTTCGACGGAAAGAAAATAACGGTTACTGGTACGTTATGGAACG
GAGCCAAGATAATAGACGAGAGATTAATAACGCCAGACGGAAGTATGAGT
TTCCAGGTTACGATAAACTCG ATG-5684 M44Q Amino acid
                                         (SEQ ID NO: 674)
FTLEDFVGDWKQTAAYNLDQVLEQGGVSSLLQNLAVSVTPIQRQVRSGEN
ALKIDIHVIIPYEGLSADQMAQIEEVFKVVYPVDDHHFKVILHYGTLVID
GVTPNMLNYFGRPYEGIAVFDGKKITVTGTLWNGAKIIDERLITPDGSMS
FQVTINS ATG-5685 5534 + M44R Nucleotide
                                         (SEQ ID NO: 675)
TTCACTTTGGAAGATTTCGTGGGTGACTGGAAACAGACTGCAGCATACAA
CTTAGACCAAGTGTTGGAACAGGGTGGAGTTAGTTCGCTTTTACAGAATT
TGGCAGTTAGTGTTACGCCTATACAACGTCGGGTGAGATCGGGAGAAAAT
GCATTAAAAATAGACATACATGTGATAATACCTTATGAAGGATTATCGGC
AGACCAAATGGCACAGATAGAAGAGGTTTTTAAAGTTGTTTACCCAGTTG
ATGATCATCACTTTAAAGTTATATTACACTATGGAACTTTAGTTATAGAC
GGTGTGACTCCTAACATGTTAAACTATTTCGGTAGACCTTATGAAGGAAT
AGCAGTTTTCGACGGAAAGAAAATAACGGTTACTGGTACGTTATGGAACG
GAGCCAAGATAATAGACGAGAGATTAATAACGCCAGACGGAAGTATGAGT
TTCCAGGTTACGATAAACTCG ATG-5685 5534 + M44R amino acid
                                         (SEQ ID NO: 676)
FTLEDFVGDWKQTAAYNLDQVLEQGGVSSLLQNLAVSVTPIQRRVRSGEN
ALKIDIHVIIPYEGLSADQMAQIEEVFKVVYPVDDHHFKVILHYGTLVID
GVTPNMLNYFGRPYEGIAVFDGKKITVTGTLWNGAKIIDERLITPDGSMS
FQVTINS ATG-5686 5534 + M44T Nucleotide
                                         (SEQ ID NO: 677)
TTCACTTTGGAAGATTTCGTGGGTGACTGGAAACAGACTGCAGCATACAA
CTTAGACCAAGTGTTGGAACAGGGTGGAGTTAGTTCGCTTTTACAGAATT
TGGCAGTTAGTGTTACGCCTATACAACGTACGGTGAGATCGGGAGAAAAT
GCATTAAAAATAGACATACATGTGATAATACCTTATGAAGGATTATCGGC
AGACCAAATGGCACAGATAGAAGAGGTTTTTAAAGTTGTTTACCCAGTTG
ATGATCATCACTTTAAAGTTATATTACACTATGGAACTTTAGTTATAGAC
GGTGTGACTCCTAACATGTTAAACTATTTCGGTAGACCTTATGAAGGAAT
AGCAGTTTTCGACGGAAAGAAAATAACGGTTACTGGTACGTTATGGAACG
GAGCCAAGATAATAGACGAGAGATTAATAACGCCAGACGGAAGTATGAGT
TTCCAGGTTACGATAAACTCG ATG-5686 5534 + M44T amino acid
                                         (SEQ ID NO: 678)
FTLEDFVGDWKQTAAYNLDQVLEQGGVSSLLQNLAVSVTPIQRTVRSGEN
ALKIDIHVIIPYEGLSADQMAQIEEVFKVVYPVDDHHFKVILHYGTLVID
GVTPNMLNYFGRPYEGIAVFDGKKITVTGTLWNGAKIIDERLITPDGSMS
FQVTINS ATG-5687 5534 + M44Y Nucleotide
                                         (SEQ ID NO: 679)
TTCACTTTGGAAGATTTCGTGGGTGACTGGAAACAGACTGCAGCATACAA
CTTAGACCAAGTGTTGGAACAGGGTGGAGTTAGTTCGCTTTTACAGAATT
TGGCAGTTAGTGTTACGCCTATACAACGTTATGTGAGATCGGGAGAAAAT
GCATTAAAAATAGACATACATGTGATAATACCTTATGAAGGATTATCGGC
AGACCAAATGGCACAGATAGAAGAGGTTTTTAAAGTTGTTTACCCAGTTG
ATGATCATCACTTTAAAGTTATATTACACTATGGAACTTTAGTTATAGAC
GGTGTGACTCCTAACATGTTAAACTATTTCGGTAGACCTTATGAAGGAAT
AGCAGTTTTCGACGGAAAGAAAATAACGGTTACTGGTACGTTATGGAACG
GAGCCAAGATAATAGACGAGAGATTAATAACGCCAGACGGAAGTATGAGT
```

TTCCAGGTTACGATAAACTCG

ATG-5687 5534 + M44Y Amino acid
(SEQ ID NO: 680)
FTLEDFVGDWKQTAAYNLDQVLEQGGVSSLLQNLAVSVTPIQRYVRSGEN
ALKIDIHVIIPYEGLSADQMAQIEEVFKVVYPVDDHHFKVILHYGTLVID
GVTPNMLNYFGRPYEGIAVFDGKKITVTGTLWNGAKIIDERLITPDGSMS
FQVTINS ATG-5688 5534 + M44L Nucleotide
(SEQ ID NO: 681)
TTCACTTTGGAAGATTTCGTGGGTGACTGGAAACAGACTGCAGCATACAA
CTTAGACCAAGTGTTGGAACAGGGTGGAGTTAGTTCGCTTTTACAGAATT
TGGCAGTTAGTGTTACGCCTATACAACGTCTGGTGAGATCGGGAGAAAAT
GCATTAAAAATAGACATACATGTGATAATACCTTATGAAGGATTATCGGC
AGACCAAATGGCACAGATAGAAGAGGTTTTTAAAGTTGTTTACCCAGTTG
ATGATCATCACTTTAAAGTTATATTACACTATGGAACTTTAGTTATAGAC
GGTGTGACTCCTAACATGTTAAACTATTTCGGTAGACCTTATGAAGGAAT
AGCAGTTTTCGACGGAAAGAAAATAACGGTTACTGGTACGTTATGGAACG
GAGCCAAGATAATAGACGAGAGATTAATAACGCCAGACGGAAGTATGAGT
TTCCAGGTTACGATAAACTCG ATG-5688 5534 + M44L amino acid
(SEQ ID NO: 682)
FTLEDFVGDWKQTAAYNLDQVLEQGGVSSLLQNLAVSVTPIQRLVRSGEN
ALKIDIHVIIPYEGLSADQMAQIEEVFKVVYPVDDHHFKVILHYGTLVID
GVTPNMLNYFGRPYEGIAVFDGKKITVTGTLWNGAKIIDERLITPDGSMS
FQVTINS ATG-5689 5534 + M44P Nucleotide
(SEQ ID NO: 683)
TTCACTTTGGAAGATTTCGTGGGTGACTGGAAACAGACTGCAGCATACAA
CTTAGACCAAGTGTTGGAACAGGGTGGAGTTAGTTCGCTTTTACAGAATT
TGGCAGTTAGTGTTACGCCTATACAACGTCCTGTGAGATCGGGAGAAAAT
GCATTAAAAATAGACATACATGTGATAATACCTTATGAAGGATTATCGGC
AGACCAAATGGCACAGATAGAAGAGGTTTTTAAAGTTGTTTACCCAGTTG
ATGATCATCACTTTAAAGTTATATTACACTATGGAACTTTAGTTATAGAC
GGTGTGACTCCTAACATGTTAAACTATTTCGGTAGACCTTATGAAGGAAT
AGCAGTTTTCGACGGAAAGAAAATAACGGTTACTGGTACGTTATGGAACG
GAGCCAAGATAATAGACGAGAGATTAATAACGCCAGACGGAAGTATGAGT
TTCCAGGTTACGATAAACTCG ATG-5689 5534 + M44P amino acid
(SEQ ID NO: 684)
FTLEDFVGDWKQTAAYNLDQVLEQGGVSSLLQNLAVSVTPIQRPVRSGEN
ALKIDIHVIIPYEGLSADQMAQIEEVFKVVYPVDDHHFKVILHYGTLVID
GVTPNMLNYFGRPYEGIAVFDGKKITVTGTLWNGAKIIDERLITPDGSMS
FQVTINS ATG-5590 5534 + M44F Nucleotide
(SEQ ID NO: 685)
TTCACTTTGGAAGATTTCGTGGGTGACTGGAAACAGACTGCAGCATACAA
CTTAGACCAAGTGTTGGAACAGGGTGGAGTTAGTTCGCTTTTACAGAATT
TGGCAGTTAGTGTTACGCCTATACAACGTTTTGTGAGATCGGGAGAAAAT
GCATTAAAAATAGACATACATGTGATAATACCTTATGAAGGATTATCGGC
AGACCAAATGGCACAGATAGAAGAGGTTTTTAAAGTTGTTTACCCAGTTG
ATGATCATCACTTTAAAGTTATATTACACTATGGAACTTTAGTTATAGAC
GGTGTGACTCCTAACATGTTAAACTATTTCGGTAGACCTTATGAAGGAAT
AGCAGTTTTCGACGGAAAGAAAATAACGGTTACTGGTACGTTATGGAACG
GAGCCAAGATAATAGACGAGAGATTAATAACGCCAGACGGAAGTATGAGT
TTCCAGGTTACGATAAACTCG ATG-5590 5534 + M44F Amino acid
(SEQ ID NO: 686)
FTLEDFVGDWKQTAAYNLDQVLEQGGVSSLLQNLAVSVTPIQRFVRSGEN
ALKIDIHVIIPYEGLSADQMAQIEEVFKVVYPVDDHHFKVILHYGTLVID
GVTPNMLNYFGRPYEGIAVFDGKKITVTGTLWNGAKIIDERLITPDGSMS
FQVTINS ATG-5788 Nucleotide
(SEQ ID NO: 687)
Atgaaacatcaccatcaccatcatgcgatcgccatggtcttcacactcga
cgatttcgttggggactgggaacagacagccgcctacaacctggaccaag
tccttgaacagggaggtgtgtccagtttgctgcagaatctcgccgtgtcc
gtaactccgatccaaaggattgtccggagcggtgaaaatgccctgaagat
cgacatccatgtcatcatcccgtatgaaggtctgagcgccgaccaaatgg
cccagatcgaagaggtgtttaaggtggtgtaccctgtggatgatcatcac
tttaaggtgatcctgccctatggcacactggtaatcgacggggttacgcc
gaacatgctgaactatttcggacggccgtatgaaggcatcgccgtgttcg
acggcaaaaagatcactgtaacagggaccctgtggaacggcaacaaaatt
atcgacgagcgcctgatcacccccgacggctccatgctgttccgagtaac
catcaacgcgttagcggctggcgcctgttcaagaagatcagc ATG-5788 Amino Acid
(SEQ ID NO: 688)
MKHHHHHHAIAMVFTLDDFVGDWEQTAAYNLDQVLEQGGVSSLLQNLAVS
VTPIQRIVRSGENALKIDIHVIIPYEGLSADQMAQIEEVFKVVYPVDDHH
FKVILPYGTLVIDGVTPNMLNYFGRPYEGIAVFDGKKITVTGTLWNGNKI
IDERLITPDGSMLFRVTINGVSGWRLFKKIS ATG-5789 Nucleotide
(SEQ ID NO: 689)
Atgaaacatcaccatcaccatcatgcgatcgccatggtcttcacactcga
agatttcgttggggactgggaacagacagccgcctacaacctggaccaag
tccttgaacagggaggtgtgtccagtttgctgcagaatctcgccgtgtcc
gtaactccgatccaaaggattgtccggagcggtgaaaatgccctgaagat
cgacatccatgtcatcatcccgtatgaaggtctgagcgccgaccaaatgg
cccagatcgaagaggtgtttaaggtggtgtaccctgtggatgatcatcac
tttaaggtgatcctgccctatggcacactggtaatcgacggggttacgcc
gaacatgctgaactatttcggacggccgtatgaaggcatcgccgtgttcg
acggcaaaaagatcactgtaacagggaccctgtggaacggcaacaaaatt ATG-5789 Amino Acid
(SEQ ID NO: 690)
MKHHHHHHAIAMVFTLEDFVGDWEQTAAYNLDQVLEQGGVSSLLQNLAVS
VTPIQRIVRSGENALKIDIHVIIPYEGLSADQMAQIEEVFKVVYPVDDHH
FKVILPYGTLVIDGVTPNMLNYFGRPYEGIAVFDGKKITVTGTLWNGNKI
IDERLITPDKSMLFRVTINGVSGWRLFKKIS ATG-5790 Nucleotide
(SEQ ID NO: 691)
Atgaaacatcaccatcaccatcatgcgatcgccatggtcttcacactcga
agatttcgttggggactgggaacagacagccgcctacaacctggaccaag
tccttgaacagggaggtgtgtccagtttgctgcagaatctcgccgtgtcc
gtaactccgatccaaaggattgtccggagcggtgaaaatgccctgaagat
cgacatccatgtcatcatcccgtatgaaggtctgagcgccgaccaaatgg
cccagatcgaagaggtgtttaaggtggtgtaccctgtggatgatcatcac
tttaaggtgatcctgccctatggcacactggtaatcgacgggttacgcc
gaacatgctgaactatttcggacggccgtatgaaggcatcgccgtgttcg
acggcaaaaagatcactgtaacagggaccctgtggaacggcaacaaaatt
atcgacgagcgcctgatcaccccgacggctccatgctgttccgagtaac
catcaacaaggttagcggctggcgcctgttcaagaagatcagc ATG-5790 Amino Acid
(SEQ ID NO: 692)
MKHHHHHHAIAMVFTLEDFVGDWEQTAAYNLDQVLEQGGVSSLLQNLAVS
VTPIQRIVRSGENALKIDIHVIIPYEGLSADQMAQIEEVFKVVYPVDDHH
FKVILPYGTLVIDGVTPNMLNYFGRPYEGIAVFDGKKITVTGTLWNGNKI
IDERLITPDGSMLFRVTINKVSGWRLFKKIS ATG-5791 Nucleotide
(SEQ ID NO: 693)
Atgaaacatcaccatcaccatcatgcgatcgccatggtcttcacactcga
agatttcgttggggactgggaacagacagccgcctacaacctggaccaag
tccttgaacagggaggtgtgtccagtttgctgcagaatctcgccgtgtcc
gtaactccgatccaaaggattgtccggagcggtgaaaatgccctgaagat
cgacatccatgtcatcatcccgtatgaaggtctgagcgccgaccaaatgg
cccagatcgaagaggtgtttaaggtggtgtaccctgtggatgatcatcac
tttaaggtgatcctgccctatggcacactggtaatcgacgggttacgcc
gaacatgctgaactatttcggacggccgtatgaaggcatcgccgtgttcg
acggcgagaagatcactgtaacagggaccctgtggaacggcaacaaaatt
atcgacgagcgcctgatcaccccgacggctccatgctgttccgagtaac
catcaacggcgttagcggctggcgcctgttcaagaagatcagc ATG-5791 Amino Acid
(SEQ ID NO: 694)
MKHHHHHHAIAMVFTLEDFVGDWEQTAAYNLDQVLEQGGVSSLLQNLAVS
VTPIQRIVRSGENALKIDIHVIIPYEGLSADQMAQIEEVFKVVYPVDDHH
FKVILPYGTLVIDGVTPNMLNYFGRPYEGIAVFDGEKITVTGTLWNGNKI
IDERLITPDGSMLFRVTINGVSGWRLFKKIS ATG-5792 Nucleotide
(SEQ ID NO: 695)
Atgaaacatcaccatcaccatcatgcgatcgccatggtcttcacactcga
agatttcgttggggactgggaacagacagccgcctacaacctggaccaag
tccttgaacagggaggtgtgtccagtttgctgcagaatctcgccgtgtcc
gtaactccgatccaaaggattgtccggagcggtgaaaatgccctgaagat
cgacatccatgtcatcatcccgtatgaaggtctgagcgccgaccaaatgg
cccagatcgaagaggtgtttaaggtggtgtaccctgtggatgatcatcac
tttaaggtgatcctgccctatggcacactggtaatcgacggggttacgcc
gaacaagctgaactatttcggacggccgtatgaaggcatcgccgtgttcg
acggcaaaaagatcactgtaacagggaccctgtggaacggcaacaaaatt
atcgacgagcgcctgatcaccccgacggctccatgctgttccgagtaac
catcaacggcgttagcggctggcgcctgttcaagaagatcagc ATG-5792 Amino Acid
(SEQ ID NO: 696)
MKHHHHHHAIAMVFTLEDFVGDWEQTAAYNLDQVLEQGGVSSLLQNLAVS
VTPIQRIVRSGENALKIDIHVIIPYEGLSADQMAQIEEVFKVVYPVDDHH
FKVILPYGTLVIDGVTPNKLNYFGRPYEGIAVFDGKKITVTGTLWNGNKI
IDERLITPDGSMLFRVTINGVSGWRLFKKIS ATG-5793 Nucleotide
(SEQ ID NO: 697)
Atgaaacatcaccatcaccatcatgcgatcgccatggtcttcacactcga
agatttcgttggggactgggaacagacagccgcctacaacctggaccaag
tccttgaacagggaggtgtgtccagtttgctgcagaatctcgccgtgtcc
gtaactccgatccaaaggattgtccggagcggtgaaaatgccctgaagat
cgacatccatgtcatcatcccgtatgaaggtctgagcgccgaccaaatgg
cccagatcgaagaggtgtttaaggtggtgtaccctgtggatgatcatcac
tttaaggtgatcctgccctatggcacactggtaatcgacggggttacgcc
gaacatgctgaactatttcggacggccgtatgaaggcatcgccgtgttcg
acggcaaaaagatcactgtaacagggaccctgtggaacggcaacaaaatt
atcgacgagcgcctgatcaccccgacggctccatgctgttccgagtaac
catccaggcgttagcggctggcgcctgttcaagaagatcagc ATG-5793 Amino Acid
(SEQ ID NO: 698)
MKHHHHHHAIAMVFTLEDFVGDWEQTAAYNLDQVLEQGGVSSLLQNLAVS
VTPIQRIVRSGENALKIDIHVIIPYEGLSADQMAQIEEVFKVVYPVDDHH
FKVILPYGTLVIDGVTPNMLNYFGRPYEGIAVFDGKKITVTGTLWNGNKI
IDERLITPDGSMLFRVTIQGVSGWRLFKKIS ATG-5794 Nucleotide
(SEQ ID NO: 699)
Atgaaacatcaccatcaccatcatgcgatcgccatggtcttcacactcga
agatttcgttggggactgggaacagacagccgcctacaacctggaccaag
tccttgaacagggaggtgtgtccagtttgctgcagaatctcgccgtgtcc
gtaactccgatccaaaggattgtccggagcggtgaaaatgccctgaagat
cgacatccatgtcatcatcccgtatgaaggtctgagcgccgaccaaatgg ATG-5794 Amino Acid
(SEQ ID NO: 700)
MKHHHHHHAIAMVFTLEDFVGDWEQTAAYNLDQVLEQGGVSSLLQNLAVS
VTPIQRIVRSGENALKIDIHVIIPYEGLSADQMAQIEEVFKVVYPVDDHH
FKVILPYGTLVIDGVTPNMLNYFGRPYEGIAVFDGKKITVTGTLWNGNKI
IDERLITPDKKMLFRVTIQKVSGWRLFKKIS ATG-5795 Nucleotide
(SEQ ID NO: 701)
Atgaaacatcaccatcaccatcatgcgatcgccatggtcttcacactcga
agatttcgttggggactgggaacagacagccgcctacaacctggaccaag
tccttgaacagggaggtgtgtccagtttgctgcagaatctcgccgtgtcc
gtaactccgatcatgaggattgtccggagcggtgaaaatgccctgaagat
cgacatccatgtcatcatcccgtatgaaggtctgagcgccgaccaaatgg
cccagatcgaagaggtgtttaaggtggtgtaccctgtggatgatcatcac
tttaaggtgatcctgccctatggcacactggtaatcgacggggttacgcc
gaacatgctgaactatttcggacggccgtatgaaggcatcgccgtgttcg
acggcaaaaagatcactgtaacagggaccctgtggaacggcaacaaaatt
atcgacgagcgcctgatcacccccgacggctccatgctgttccgagtaac
catcaacggcgttagcggctggcgcctgttcaagaagatcagc ATG-5795 Amino Acid
(SEQ ID NO: 702)
MKHHHHHHAIAMVFTLEDFVGDWEQTAAYNLDQVLEQGGVSSLLQNLAVS
VTPIMRIVRSGENALKIDIHVIIPYEGLSADQMAQIEEVFKVVYPVDDHH
FKVILPYGTLVIDGVTPNMLNYFGRPYEGIAVFDGKKITVTGTLWNGNKI
IDERLITPDGSMLFRVTINGVSGWRLFKKIS ATG-5796 Nucleotide
(SEQ ID NO: 703)
Atgaaacatcaccatcaccatcatgcgatcgccatggtcttcacactcga
agatttcgttggggactgggaacagacagccgcctacaacctggaccaag
tccttgaacaggaggtgtgtccagtttgctgcagaatctcgccgtgtcc
gtaactccgatccaaaggattgtccggagcggtgaaaatgccctgaagat
cgacatccatgtcatcatcccgtatgaaggtctgagcgccgaccaaatgg
cccagatcgaagaggtgtttaaggtggtgtaccctgtggatgatcatcac
tttaaggtgatcctgccctatggcacactggtaatcgacggggttacgcc
gaacatgctgaactatttcggacaccgtatgaaggcatcgccgtgttcg
acggcaaaaagatcactgtaacagggaccctgtggaacggcaacaaaatt
atcgacgagcgcctgatcacccccgacggctccatgctgttccgagtaac
catcaacggcgttagcggctggcgcctgttcaagaagatcagc ATG-5796 Amino Acid
(SEQ ID NO: 704)
MKHHHHHHAIAMVFTLEDFVGDWEQTAAYNLDQVLEQGGVSSLLQNLAVS
VTPIQRIVRSGENALKIDIHVIIPYEGLSADQMAQIEEVFKVVYPVDDHH
FKVILPYGTLVIDGVTPNMLNYFGHPYEGIAVFDGKKITVTGTLWNGNKI
IDERLITPDGSMLFRVTINGVSGWRLFKKIS ATG-5797 Nucleotide
(SEQ ID NO: 705)
Atgaaacatcaccatcaccatcatgcgatcgccatggtcttcacactcga
agatttcgttggggactgggaacagacagccgcctacaacctggaccaag
tccttgaacagggaggtgtgtccagtttgctgcagaatctcgccgtgtcc
gtaactccgatccaaaggattgtccggagcggtgaaaatgccctgaagat
cgacatccatgtcatcatcccgtatgaaggtctgagcgccgaccaaatgg
cccagatcgaagaggtgtttaaggtggtgtaccctgtggatgatcatcac
tttaaggtgatcctgccctatggcacactggtaatcgacggggttacgcc
gaacatgctgaactatttcggacggccgtatgaaggcatcgccgtgttcg
acggcaaaaagatcactgtaacagggaccctgtggaacggcaacaaaatt
atcgacgagcgcctgatcacccccgacggcaagatgctgttccgagtaac
catcaacggcgttagcggctggcgcctgttcaagaagatcagc ATG-5797 Amino Acid
(SEQ ID NO: 706)
MKHHHHHHAIAMVFTLEDFVGDWEQTAAYNLDQVLEQGGVSSLLQNLAVS
VTPIQRIVRSGENALKIDIHVIIPYEGLSADQMAQIEEVFKVVYPVDDHH
FKVILPYGTLVIDGVTPNMLNYFGRPYEGIAVFDGKKITVTGTLWNGNKI
IDERLITPDGKMLFRVTINGVSGWRLFKKIS ATG-5798 Nucleotide
(SEQ ID NO: 707)
Atgaaacatcaccatcaccatcatgcgatcgccatggtcttcacactcga
agatttcgttggggactgggaacagacagccgcctacaacctggaccaag
tccttgaacagggaggtgtgtccagtttgctgcagaatctcgccgtgtcc
gtaactccgatccaaaggattgtccggagcggtgaaaatgccctgaagat
cgacatccatgtcatcatcccgtatgaaggtctgagcgccgaccaaatgg
cccagatcgaagaggtgtttaaggtggtgtaccctgtggatgatcatcac
tttaaggtgatcctgccctatggcacactggtaatcgacggggttacgcc
gaacatgctgaactatttcggacggccgtatgaaggcatcgccgtgttcg
acggcaaaaagatcactgtaacagggaccctgtggaacggcaacaaaatt
atcgacgagcgcctgatcgatcccgacggctccatgctgttccgagtaac
catcaacggcgttagcggctggcgcctgttcaagaagatcagc ATG-5798 Amino Acid
(SEQ ID NO: 708)
MKHHHHHHAIAMVFTLEDFVGDWEQTAAYNLDQVLEQGGVSSLLQNLAVS
VTPIQRIVRSGENALKIDIHVIIPYEGLSADQMAQIEEVFKVVYPVDDHH
FKVILPYGTLVIDGVTPNMLNYFGRPYEGIAVFDGKKITVTGTLWNGNKI
IDERLIDPDGSMLFRVTINGVSGWRLFKKIS ATG-5799 Nucleotide
(SEQ ID NO: 709)
Atgaaacatcaccatcaccatcatgcgatcgccatggatttcacactcga agatttcgttggggactgggaacagacagccgcctacaacctggaccaag tccttgaacagggaggtgtgtccagtttgctgcagaatctcgccgtgtcc gtaactccgatccaaaggattgtccggagcggtgaaaatgccctgaagat cgacatccatgtcatcatcccgtatgaaggtctgagcgccgaccaaatgg cccagatcgaagaggtgtttaaggtggtgtaccctgtggatgatcatcac tttaaggtgatcctgccctatggcacactggtaatcgacggggttacgcc gaacatgctgaactatttcggacggccgtatgaaggcatcgccgtgttcg acggcaaaaagatcactgtaacagggaccctgtggaacggcaacaaaatt atcgacgagcgcctgatcacccccgacggctccatgctgttccgagtaac catcaacggcgttagcggctggcgcctgttcaagaagatcagc ATG-5799 Amino Acid
(SEQ ID NO: 710)
MKHHHHHHAIAMDFTLEDFVGDWEQTAAYNLDQVLEQGGVSSLLQNLAVS

VTPIQRIVRSGENALKIDIHVIIPYEGLSADQMAQIEEVFKVVYPVDDHH

FKVILPYGTLVIDGVTPNMLNYFGRPYEGIAVFDGKKITVTGTLWNGNKI

IDERLITPDGSMLFRVTINGVSGWRLFKKIS

ATG-5800 Nucleotide
(SEQ ID NO: 711)
Atgaaacatcaccatcaccatcatgcgatcgccatggtcttcacactcga agatttcgttggggactgggaacagacagccgcctacaacctggaccaag tccttgaacagggaggtgtgtccagtttgctgcagaatctcgccgtgtcc gtaactccgatccaaaggattgtccggagcggtgaaaatgccctgaagat cgacatccatgtcatcatcccgtatgaaggtctgagcgccgaccaaatgg cccagatcgaagaggtgtttaaggtggtgtaccctgtggatgatcatcac tttaaggtgatcctgccctatggcacactggtaatcgacggggttacgcc gaacatgctgaactatttcggacggccgtatgaaggcatcgccgtgttcg acggcaaaaagatcactaccacagggaccctgtggaacggcaacaaaatt atcgacgagcgcctgatcacccccgacggctccatgctgttccgagtaac catcaacggcgttagcggctggcgcctgttcaagaagatcagc ATG-5800 Amino Acid
(SEQ ID NO: 712)
MKHHHHHHAIAMVFTLEDFVGDWEQTAAYNLDQVLEQGGVSSLLQNLAVS

VTPIQRIVRSGENALKIDIHVIIPYEGLSADQMAQIEEVFKVVYPVDDHH

FKVILPYGTLVIDGVTPNMLNYFGRPYEGIAVFDGKKITTTGTLWNGNKI

IDERLITPDGSMLFRVTINGVSGWRLFKKIS

ATG-5801 Nucleotide
(SEQ ID NO: 713)
Atgaaacatcaccatcaccatcatgcgatcgccatggtcttcacactcga agatttcgttggggactgggaacagacagccgcctacaacctggaccaag tccttgaacagggaggtgtgtccagtttgctgcagaatctcgccgtgtcc gtaactccgatccaaaggattgtccggagcggtgaaaatgccctgaagat cgacatccatgtcatcatcccgtatgaaggtctgagcgccgaccaaatgg cccagatcgaagaggtgtttaaggtggtgtaccctgtggatgatcatcac tttaaggtgatcctgccctatggcacactggtaatcgacggggttacgcc gaacatgctgaactatttcggacggccgtatgaaggcatcgccgtgttcg acggcaaaaagatcactgtaacagggaccctgtggaacggcaacaaaatt atcgacgagcgcctgatcacccccgacggctccatgctgttccgagtaac catcaacggcgttagcggctggcgcctgttcaagaagatcagc ATG-5801 Amino Acid
(SEQ ID NO: 714)
MKHHHHHHAIAMVFTLEDFVGDWEQTAAYNLDQVLEQGGVSSLLQNLAVS

VTPIQRIVRSGENALKIDIHVIIPYEGLSADQMAQIEEVFKVVYPVDDHH

FKVILPIGTLVIDGVTPNMLNYFGRPYEGIAVFDGKKITVTGTLWNGNKI

IDERLITPDGSMLFRVTINGVSGWRLFKKIS

ATG-5802 Nucleotide
(SEQ ID NO: 715)
Atgaaacatcaccatcaccatcatgcgatcgccatggtcttcacactcga agatttcgttggggactgggaacagacagccgcctacaacctggaccaag tccttgaacagggaggtgtgtccagtttgctgcagaatctcgccgtgtcc gtaactccgatccaaaggattgtccggagcggtgaaaatgccctgaagat cgacatccatgtcatcatcccgtatgaaggtctgagcgccgaccaaatgg cccagatcgaagaggtgtttaaggtggtgtaccctgtggatgatcatcac tttaaggtgatcctgccctatggcacactggtaatcgacggggttacgcc gaacatgctgaactatttcggacggccgtatgaaggcatcgccgtgttcg acggcaaaaagatcactgtaacagggaccctgtggaacggcaacaaaatt atcgacgagcgcctgatcacccccgacggctccatgctgttccgagtaac catcaacggcgtgaccggctggcggctgtgcgaacgcattctg ATG-5802 Amino Acid
(SEQ ID NO: 716)
MKHHHHHHAIAMVFTLEDFVGDWEQTAAYNLDQVLEQGGVSSLLQNLAVS

VTPIQRIVRSGENALKIDIHVIIPYEGLSADQMAQIEEVFKVVYPVDDHH

FKVILPYGTLVIDGVTPNMLNYFGRPYEGIAVFDGKKITVTGTLWNGNKI

IDERLITPDGVTGWRLCERIL

ATG-5803 Nucleotide
(SEQ ID NO: 717)
Atgaaacatcaccatcaccatcatgcgatcgccatggatttcacactcga cgatttcgttggggactgggaacagacagccgcctacaacctggaccaag tccttgaacagggaggtgtgtccagtttgctgcagaatctcgccgtgtcc gtaactccgatcatgaggattgtccggagcggtgaaaatgccctgaagat cgacatccatgtcatcatcccgtatgaaggtctgagcgccgaccaaatgg cccagatcgaagaggtgtttaaggtggtgtaccctgtggatgatcatcac tttaaggtgatcctgccccatcggcacactggtaatcgacggggttacgcc gaacaagctgaactatttcggacaccgtatgaaggcatcgccgtgttcg acggcgagaagatcactaccacagggaccctgtggaacggcaacaaaatt atcgacgagcgcctgatcgatcccgacaagaagatgctgttccgagtaac catccagaaggttagcggctggcgcctgttcaagaagatcagc ATG-5803 Amino Acid
(SEQ ID NO: 718)
MKHHHHHHAIAMDFTLDDFVGDWEQTAAYNLDQVLEQGGVSSLLQNLAVS

VTPIMRIVRSGENALKIDIHVIIPYEGLSADQMAQIEEVFKVVYPVDDHH

FKVILPIGTLVIDGVTPNKLNYFGHPYEGIAVFDGEKITTTGTLWNGNKI

IDERLIDPDKKMLFRVTIQKVSGWRLFKKIS

ATG-5804 Nucleotide
(SEQ ID NO: 719)
Atgaaacatcaccatcaccatcatgcgatcgccatggatttcacactcga cgatttcgttggggactgggaacagacagccgcctacaacctggaccaag tccttgaacagggaggtgtgtccagtttgctgcagaatctcgccgtgtcc gtaactccgatcatgaggattgtccggagcggtgaaaatgccctgaagat cgacatccatgtcatcatcccgtatgaaggtctgagcgccgaccaaatgg cccagatcgaagaggtgtttaaggtggtgtaccctgtggatgatcatcac tttaaggtgatcctgcccatcggcacactggtaatcgacggggttacgcc gaacaagctgaactatttcggacacccgtatgaaggcatcgccgtgttcg acggcgagaagatcactaccacagggaccctgtggaacggcaacaaaatt atcgacgagcgcctgatcgatcccgacggctccatgctgttccgagtaac catcaacgcgttagcggctggcgcctgttcaagaagatcagc ATG-5804 Amino Acid
(SEQ ID NO: 720)
MKHHHHHHAIAMDFTLDDFVGDWEQTAAYNLDQVLEQGGVSSLLQNLAVS

VTPIMRIVRSGENALKIDIHVIIPYEGLSADQMAQIEEVFKVVYPVDDHH

FKVILPIGTLVIDGVTPNKLNYFGHPYEGIAVFDGEKITTTGTLWNGNKI

IDERLIDPDKKMLFRVTIQKVSGWRLFKKIS

Example 52-Circularly permuted LgBiT
ATG-4992 PEP78-8GS-LGTRIP3546-6HIS Nucleotide
(SEQ ID NO: 721)
ATGAACGTGAGCGGCTGGCGGCTGTTCAAGAAGATTAGCAACGGCTCGAG

CGGTGGCTCGAGCGGTTTCACACTCGACGATTTCGTTGGGGACTGGGAAC

AGACAGCCGCCTACAACCTGGACCAAGTCCTTGAACAGGGAGGTGTGTCC

AGTTTGCTGCAGAATCTCGCCGTGTCCGTAACTCCGATCATGAGGATTGT

CCGGAGCGGTGAAAATGCCCTGAAGATCGACATCCATGTCATCATCCCGT

ATGAAGGTCTGAGCGCCGACCAAATGGCCCAGATCGAAGAGGTGTTTAAG

GTGGTGTACCCTGTGGATGATCATCACTTTAAGGTGATCCTGCCCTATGG

CACACTGGTAATCGACGGGGTTACGCCGAACAAGCTGAACTATTTCGGAC

GGCCGTATGAAGGCATCGCCGTGTTCGACGGCAAAAAGATCACTACCACA

GGGACCCTGTGGAACGGCAACAAAATTATCGACGAGCGCCTGATCACCCC

CGACCATCACCATCACCATCAT

ATG-4992 PEP78-8GS-LGTRIP3546-6HIS amino acid
(SEQ ID NO: 722)
MNVSGWRLFKKISNGSSGGSSGFTLDDFVGDWEQTAAYNLDQVLEQGGVS

SLLQNLAVSVTPIMRIVRSGENALKIDIHVIIPYEGLSADQMAQIEEVFK

VVYPVDDHHFKVILPYGTLVIDGVTPNKLNYFGRPYEGIAVFDGKKITTT

GTLWNGNKIIDERLITPDHHHHHH

ATG-4993 PEP79-8GS-LGTRIP3546-6HIS nucleotide
(SEQ ID NO: 723)
ATGAACGTGACCGGCTACCGGCTGTTCAAGAAGATTAGCAACGGCTCGAG

CGGTGGCTCGAGCGGTTTCACACTCGACGATTTCGTTGGGGACTGGGAAC

AGACAGCCGCCTACAACCTGGACCAAGTCCTTGAACAGGGAGGTGTGTCC

AGTTTGCTGCAGAATCTCGCCGTGTCCGTAACTCCGATCATGAGGATTGT

CCGGAGCGGTGAAAATGCCCTGAAGATCGACATCCATGTCATCATCCCGT

ATGAAGGTCTGAGCGCCGACCAAATGGCCCAGATCGAAGAGGTGTTTAAG

GTGGTGTACCCTGTGGATGATCATCACTTTAAGGTGATCCTGCCCTATGG

CACACTGGTAATCGACGGGGTTACGCCGAACAAGCTGAACTATTTCGGAC

GGCCGTATGAAGGCATCGCCGTGTTCGACGGCAAAAAGATCACTACCACA

GGGACCCTGTGGAACGGCAACAAAATTATCGACGAGCGCCTGATCACCCC

CGACCATCACCATCACCATCAT

ATG-4993 PEP79-8GS-LGTRIP3546-6HIS amino acid
(SEQ ID NO: 724)
MNVTGYRLFKKISNGSSGGSSGFTLDDFVGDWEQTAAYNLDQVLEQGGVS

SLLQNLAVSVTPIMRIVRSGENALKIDIHVIIPYEGLSADQMAQIEEVFK

VVYPVDDHHFKVILPYGTLVIDGVTPNKLNYFGRPYEGIAVFDGKKITTT

GTLWNGNKIIDERLITPDHHHHHH

ATG-4994 PEP99-8GS-LGTRIP3546-6HIS nucleotide
(SEQ ID NO: 725)
ATGGTGACCGGCTACCGGCTGTTCGAGAAGATTAGCGGCTCGAGCGGTGG

CTCGAGCGGTTTCACACTCGACGATTTCGTTGGGGACTGGGAACAGACAG

CCGCCTACAACCTGGACCAAGTCCTTGAACAGGGAGGTGTGTCCAGTTTG

CTGCAGAATCTCGCCGTGTCCGTAACTCCGATCATGAGGATTGTCCGGAG

CGGTGAAAATGCCCTGAAGATCGACATCCATGTCATCATCCCGTATGAAG

GTCTGAGCGCCGACCAAATGGCCCAGATCGAAGAGGTGTTTAAGGTGGTG

TACCCTGTGGATGATCATCACTTTAAGGTGATCCTGCCCTATGGCACACT

GGTAATCGACGGGGTTACGCCGAACAAGCTGAACTATTTCGGACGGCCGT

ATGAAGGCATCGCCGTGTTCGACGGCAAAAAGATCACTACCACAGGGACC

CTGTGGAACGGCAACAAAATTATCGACGAGCGCCTGATCACCCCCGACCA

TCACCATCACCATCAT

ATG-4994 PEP99-8GS-LGTRIP3546-6HIS amino acid
(SEQ ID NO: 726)
MVTGYRLFEKISGSSGGSSGFTLDDFVGDWEQTAAYNLDQVLEQGGVSSL

LQNLAVSVTPIMRIVRSGENALKIDIHVIIPYEGLSADQMAQIEEVFKVV

YPVDDHHFKVILPYGTLVIDGVTPNKLNYFGRPYEGIAVFDGKKITTTGT

LWNGNKIIDERLITPDHHHHHH

ATG-4995 PEP128-8GS-LGTRIP3546-6HIS Nucleotide
(SEQ ID NO: 727)
ATGGTGACCGGCTACCGGCTGTTCGAGAAGATTCTGGGCTCGAGCGGTGG

CTCGAGCGGTTTCACACTCGACGATTTCGTTGGGGACTGGGAACAGACAG

CCGCCTACAACCTGGACCAAGTCCTTGAACAGGGAGGTGTGTCCAGTTTG

CTGCAGAATCTCGCCGTGTCCGTAACTCCGATCATGAGGATTGTCCGGAG

CGGTGAAAATGCCCTGAAGATCGACATCCATGTCATCATCCCGTATGAAG

GTCTGAGCGCCGACCAAATGGCCCAGATCGAAGAGGTGTTTAAGGTGGTG

TACCCTGTGGATGATCATCACTTTAAGGTGATCCTGCCCTATGGCACACT

GGTAATCGACGGGGTTACGCCGAACAAGCTGAACTATTTCGGACGGCCGT

ATGAAGGCATCGCCGTGTTCGACGGCAAAAAGATCACTACCACAGGGACC

CTGTGGAACGGCAACAAAATTATCGACGAGCGCCTGATCACCCCCGACCA

ATG-4995 PEP128-8GS-LGTRIP3546-6HIS amino acid
(SEQ ID NO: 728)
MVTGYRLFEKILGSSGGSSGFTLDDFVGDWEQTAAYNLDQVLEQGGVSSL

LQNLAVSVTPIMRIVRSGENALKIDIHVIIPYEGLSADQMAQIEEVFKVV

YPVDDHHFKVILPYGTLVIDGVTPNKLNYFGRPYEGIAVFDGKKITTTGT

LWNGNKIIDERLITPDHHHHHH

ATG-4996 HIBIT-8GS-LGTRIP3546-6HIS nucleotide
(SEQ ID NO: 729)
ATGGTGAGCGGCTGGCGGCTGTTCAAGAAGATTAGCGGCTCGAGCGGTGG

CTCGAGCGGTTTCACACTCGACGATTTCGTTGGGGACTGGGAACAGACAG

CCGCCTACAACCTGGACCAAGTCCTTGAACAGGGAGGTGTGTCCAGTTTG

CTGCAGAATCTCGCCGTGTCCGTAACTCCGATCATGAGGATTGTCCGGAG

CGGTGAAAATGCCCTGAAGATCGACATCCATGTCATCATCCCGTATGAAG

GTCTGAGCGCCGACCAAATGGCCCAGATCGAAGAGGTGTTTAAGGTGGTG

TACCCTGTGGATGATCATCACTTTAAGGTGATCCTGCCCTATGGCACACT

GGTAATCGACGGGGTTACGCCGAACAAGCTGAACTATTTCGGACGGCCGT

ATGAAGGCATCGCCGTGTTCGACGGCAAAAAGATCACTACCACAGGGACC

CTGTGGAACGGCAACAAAATTATCGACGAGCGCCTGATCACCCCCGACCA

TCACCATCACCATCAT

ATG-4996 HIBIT-8GS-LGTRIP3546-6HIS amino acid
(SEQ ID NO: 730)
MVSGWRLFKKISGSSGGSSGFTLDDFVGDWEQTAAYNLDQVLEQGGVSSL

LQNLAVSVTPIMRIVRSGENALKIDIHVIIPYEGLSADQMAQIEEVFKVV

YPVDDHHFKVILPYGTLVIDGVTPNKLNYFGRPYEGIAVFDGKKITTTGT

LWNGNKIIDERLITPDHHHHHH

ATG-4997 HIBIT-STOG-8GS-LGTRIP-3546-6HIS
nucleotide
(SEQ ID NO: 731)
ATGGTGAGCGGCTGGCGGCTGTTCAAGAAGATTGGCGGCTCGAGCGGTGG

CTCGAGCGGTTTCACACTCGACGATTTCGTTGGGGACTGGGAACAGACAG

CCGCCTACAACCTGGACCAAGTCCTTGAACAGGGAGGTGTGTCCAGTTTG

CTGCAGAATCTCGCCGTGTCCGTAACTCCGATCATGAGGATTGTCCGGAG

CGGTGAAAATGCCCTGAAGATCGACATCCATGTCATCATCCCGTATGAAG

GTCTGAGCGCCGACCAAATGGCCCAGATCGAAGAGGTGTTTAAGGTGGTG

TACCCTGTGGATGATCATCACTTTAAGGTGATCCTGCCCTATGGCACACT

GGTAATCGACGGGGTTACGCCGAACAAGCTGAACTATTTCGGACGGCCGT

ATGAAGGCATCGCCGTGTTCGACGGCAAAAAGATCACTACCACAGGGACC

CTGTGGAACGGCAACAAAATTATCGACGAGCGCCTGATCACCCCCGACCA

TCACCATCACCATCAT

ATG-4997 HIBIT-STOG-8GS-LGTRIP-3546-6HIS amino
acid
(SEQ ID NO: 732)
MVSGWRLFKKIGGSSGGSSGFTLDDFVGDWEQTAAYNLDQVLEQGGVSSL

LQNLAVSVTPIMRIVRSGENALKIDIHVIIPYEGLSADQMAQIEEVFKVV

YPVDDHHFKVILPYGTLVIDGVTPNKLNYFGRPYEGIAVFDGKKITTTGT

LWNGNKIIDERLITPDHHHHHH

ATG-4998 HIBIT-ISTOSG-8GS-LGTRIP-3546-6HIS
nucleotide
(SEQ ID NO: 733)
ATGGTGAGCGGCTGGCGGCTGTTCAAGAAGTCGGGCGGCTCGAGCGGTGG

CTCGAGCGGTTTCACACTCGACGATTTCGTTGGGGACTGGGAACAGACAG

CCGCCTACAACCTGGACCAAGTCCTTGAACAGGGAGGTGTGTCCAGTTTG

CTGCAGAATCTCGCCGTGTCCGTAACTCCGATCATGAGGATTGTCCGGAG

CGGTGAAAATGCCCTGAAGATCGACATCCATGTCATCATCCCGTATGAAG

GTCTGAGCGCCGACCAAATGGCCCAGATCGAAGAGGTGTTTAAGGTGGTG

TACCCTGTGGATGATCATCACTTTAAGGTGATCCTGCCCTATGGCACACT

GGTAATCGACGGGGTTACGCCGAACAAGCTGAACTATTTCGGACGGCCGT

ATGAAGGCATCGCCGTGTTCGACGGCAAAAAGATCACTACCACAGGGACC

CTGTGGAACGGCAACAAAATTATCGACGAGCGCCTGATCACCCCCGACCA

TCACCATCACCATCAT

ATG-4998 HIBIT-ISTOSG-8GS-LGTRIP-3546-6HIS amino
acid
(SEQ ID NO: 734)
MVSGWRLFKKSGGSSGGSSGFTLDDFVGDWEQTAAYNLDQVLEQGGVSSL

LQNLAVSVTPIMRIVRSGENALKIDIHVIIPYEGLSADQMAQIEEVFKVV

YPVDDHHFKVILPYGTLVIDGVTPNKLNYFGRPYEGIAVFDGKKITTTGT

LWNGNKIIDERLITPDHHHHHH

ATG-4999 HIBIT-DELETE IS-8GS-LGTRIP-3546-6HIS
nucleotide
(SEQ ID NO: 735)
ATGGTGAGCGGCTGGCGGCTGTTCAAGAAGGGCTCGAGCGGTGGCTCGAG

CGGTTTCACACTCGACGATTTCGTTGGGGACTGGGAACAGACAGCCGCCT

ACAACCTGGACCAAGTCCTTGAACAGGGAGGTGTGTCCAGTTTGCTGCAG

AATCTCGCCGTGTCCGTAACTCCGATCATGAGGATTGTCCGGAGCGGTGA

AAATGCCCTGAAGATCGACATCCATGTCATCATCCCGTATGAAGGTCTGA

GCGCCGACCAAATGGCCCAGATCGAAGAGGTGTTTAAGGTGGTGTACCCT

GTGGATGATCATCACTTTAAGGTGATCCTGCCCTATGGCACACTGGTAAT

CGACGGGGTTACGCCGAACAAGCTGAACTATTTCGGACGGCCGTATGAAG

GCATCGCCGTGTTCGACGGCAAAAAGATCACTACCACAGGGACCCTGTGG

AACGGCAACAAAATTATCGACGAGCGCCTGATCACCCCCGACCATCACCA

TCACCATCAT

ATG-4999 HIBIT-DELETE IS-8GS-LGTRIP-3546-6HIS
nucleotide amino acid
(SEQ ID NO: 736)
MVSGWRLFKKGSSGGSSGFTLDDFVGDWEQTAAYNLDQVLEQGGVSSLLQ

NLAVSVTPIMRIVRSGENALKIDIHVIIPYEGLSADQMAQIEEVFKVVYP

VDDHHFKVILPYGTLVIDGVTPNKLNYFGRPYEGIAVFDGKKITTTGTLW

NGNKIIDERLITPDHHHHHH

ATG-5000 HIBIT-DELETE S-8GS-LGTRIP-3546-6HIS
nucleotide
(SEQ ID NO: 737)
ATGGTGAGCGGCTGGCGGCTGTTCAAGAAGATTGGCTCGAGCGGTGGCTC

GAGCGGTTTCACACTCGACGATTTCGTTGGGGACTGGGAACAGACAGCCG

-continued

CCTACAACCTGGACCAAGTCCTTGAACAGGGAGGTGTGTCCAGTTTGCTG

CAGAATCTCGCCGTGTCCGTAACTCCGATCATGAGGATTGTCCGGAGCGG

TGAAAATGCCCTGAAGATCGACATCCATGTCATCATCCCGTATGAAGGTC

TGAGCGCCGACCAAATGGCCCAGATCGAAGAGGTGTTTAAGGTGGTGTAC

CCTGTGGATGATCATCACTTTAAGGTGATCCTGCCCTATGGCACACTGGT

AATCGACGGGGTTACGCCGAACAAGCTGAACTATTTCGGACGGCCGTATG

AAGGCATCGCCGTGTTCGACGGCAAAAAGATCACTACCACAGGGACCCTG

TGGAACGGCAACAAAATTATCGACGAGCGCCTGATCACCCCCGACCATCA

CCATCACCATCAT

ATG-5000 HIBIT-DELETE S-8GS-LGTRIP-3546-6HIS amino
acid
(SEQ ID NO: 738)
MVSGWRLFKKIGSSGGSSGFTLDDFVGDWEQTAAYNLDQVLEQGGVSSLL

QNLAVSVTPIMRIVRSGENALKIDIHVIIPYEGLSADQMAQIEEVFKVVY

PVDDHHFKVILPYGTLVIDGVTPNKLNYFGRPYEGIAVFDGKKITTTGTL

WNGNKIIDERLITPDHHHHHH

ATG-5001 VSHIBIT-ISTOSG-8GS-LGTRIP-3546-6HIS
nucleotide
(SEQ ID NO: 739)
ATGGTTTCCGTGAGCGGCTGGCGGCTGTTCAAGAAGTCGGGCGGCTCGAG

CGGTGGCTCGAGCGGTTTCACACTCGACGATTTCGTTGGGGACTGGGAAC

AGACAGCCGCCTACAACCTGGACCAAGTCCTTGAACAGGGAGGTGTGTCC

AGTTTGCTGCAGAATCTCGCCGTGTCCGTAACTCCGATCATGAGGATTGT

CCGGAGCGGTGAAAATGCCCTGAAGATCGACATCCATGTCATCATCCCGT

ATGAAGGTCTGAGCGCCGACCAAATGGCCCAGATCGAAGAGGTGTTTAAG

GTGGTGTACCCTGTGGATGATCATCACTTTAAGGTGATCCTGCCCTATGG

CACACTGGTAATCGACGGGGTTACGCCGAACAAGCTGAACTATTTCGGAC

GGCCGTATGAAGGCATCGCCGTGTTCGACGGCAAAAAGATCACTACCACA

GGGACCCTGTGGAACGGCAACAAAATTATCGACGAGCGCCTGATCACCCC

CGACCATCACCATCACCATCAT

ATG-5001 VSHIBIT-ISTOSG-8GS-LGTRIP-3546-6HIS amino
acid
(SEQ ID NO: 740)
MVSVSGWRLFKKSGGSSGGSSGFTLDDFVGDWEQTAAYNLDQVLEQGGVS

SLLQNLAVSVTPIMRIVRSGENALKIDIHVIIPYEGLSADQMAQIEEVFK

VVYPVDDHHFKVILPYGTLVIDGVTPNKLNYFGRPYEGIAVFDGKKITTT

GTLWNGNKIIDERLITPDHHHHHH

ATG-5002 VSHIBIT-STOG-8GS-LGTRIP-3546-6HIS
nucleotide
(SEQ ID NO: 741)
ATGGTTTCCGTGAGCGGCTGGCGGCTGTTCAAGAAGATTGGCGGCTCGAG

CGGTGGCTCGAGCGGTTTCACACTCGACGATTTCGTTGGGGACTGGGAAC

AGACAGCCGCCTACAACCTGGACCAAGTCCTTGAACAGGGAGGTGTGTCC

AGTTTGCTGCAGAATCTCGCCGTGTCCGTAACTCCGATCATGAGGATTGT

CCGGAGCGGTGAAAATGCCCTGAAGATCGACATCCATGTCATCATCCCGT

ATGAAGGTCTGAGCGCCGACCAAATGGCCCAGATCGAAGAGGTGTTTAAG

GTGGTGTACCCTGTGGATGATCATCACTTTAAGGTGATCCTGCCCTATGG

CACACTGGTAATCGACGGGGTTACGCCGAACAAGCTGAACTATTTCGGAC

GGCCGTATGAAGGCATCGCCGTGTTCGACGGCAAAAAGATCACTACCACA

GGGACCCTGTGGAACGGCAACAAAATTATCGACGAGCGCCTGATCACCCC

CGACCATCACCATCACCATCAT

ATG-5002 VSHIBIT-STOG-8GS-LGTRIP-3546-6HIS amino
acid
(SEQ ID NO: 742)
MVSVSGWRLFKKIGGSSGGSSGFTLDDFVGDWEQTAAYNLDQVLEQGGVS

SLLQNLAVSVTPIMRIVRSGENALKIDIHVIIPYEGLSADQMAQIEEVFK

VVYPVDDHHFKVILPYGTLVIDGVTPNKLNYFGRPYEGIAVFDGKKITTT

GTLWNGNKIIDERLITPDHHHHHH

ATG-5003 VSHIBIT-DELETE IS-8GS-LGTRIP-3546-6HIS
nucleotide
(SEQ ID NO: 743)
ATGGTTTCCGTGAGCGGCTGGCGGCTGTTCAAGAAGGGCTCGAGCGGTGG

CTCGAGCGGTTTCACACTCGACGATTTCGTTGGGGACTGGGAACAGACAG

CCGCCTACAACCTGGACCAAGTCCTTGAACAGGGAGGTGTGTCCAGTTTG

CTGCAGAATCTCGCCGTGTCCGTAACTCCGATCATGAGGATTGTCCGGAG

CGGTGAAAATGCCCTGAAGATCGACATCCATGTCATCATCCCGTATGAAG

GTCTGAGCGCCGACCAAATGGCCCAGATCGAAGAGGTGTTTAAGGTGGTG

TACCCTGTGGATGATCATCACTTTAAGGTGATCCTGCCCTATGGCACACT

GGTAATCGACGGGGTTACGCCGAACAAGCTGAACTATTTCGGACGGCCGT

ATGAAGGCATCGCCGTGTTCGACGGCAAAAAGATCACTACCACAGGGACC

CTGTGGAACGGCAACAAAATTATCGACGAGCGCCTGATCACCCCCGACCA

TCACCATCACCATCAT

ATG-5003 VSHIBIT-DELETE IS-8GS-LGTRIP-3546-6HIS
amino acid
(SEQ ID NO: 744)
MVSVSGWRLFKKGSSGGSSGFTLDDFVGDWEQTAAYNLDQVLEQGGVSSL

LQNLAVSVTPIMRIVRSGENALKIDIHVIIPYEGLSADQMAQIEEVFKVV

YPVDDHHFKVILPYGTLVIDGVTPNKLNYFGRPYEGIAVFDGKKITTTGT

LWNGNKIIDERLITPDHHHHHH

ATG-5004 VSHIBIT-DELETE S-8GS-LGTRIP-3546-6HIS
nucleotide
(SEQ ID NO: 745)
ATGGTTTCCGTGAGCGGCTGGCGGCTGTTCAAGAAGATTGGCTCGAGCGG

TGGCTCGAGCGGTTTCACACTCGACGATTTCGTTGGGGACTGGGAACAGA

CAGCCGCCTACAACCTGGACCAAGTCCTTGAACAGGGAGGTGTGTCCAGT

TTGCTGCAGAATCTCGCCGTGTCCGTAACTCCGATCATGAGGATTGTCCG

GAGCGGTGAAAATGCCCTGAAGATCGACATCCATGTCATCATCCCGTATG

AAGGTCTGAGCGCCGACCAAATGGCCCAGATCGAAGAGGTGTTTAAGGTG

GTGTACCCTGTGGATGATCATCACTTTAAGGTGATCCTGCCCTATGGCAC

ACTGGTAATCGACGGGGTTACGCCGAACAAGCTGAACTATTTCGGACGGC

GTATGAAGGCATCGCCGTGTTCGACGGCAAAAAGATCACTACCACAGGG

ACCCTGTGGAACGGCAACAAAATTATCGACGAGCGCCTGATCACCCCCGA

CCATCACCATCACCATCAT

ATG-5004 VSHIBIT-DELETE S-8GS-LGTRIP-3546-6HIS amino acid
(SEQ ID NO: 746)
MVSVSGWRLFKKIGSSGGSSGFTLDDFVGDWEQTAAYNLDQVLEQGGVSS
LLQNLAVSVTPIMRIVRSGENALKIDIHVIIPYEGLSADQMAQIEEVFKV
VYPVDDHHFKVILPYGTLVIDGVTPNKLNYFGRPYEGIAVFDGKKITTTG
TLWNGNKIIDERLITPDHHHHHH ATG-5485 PEP78-5GS-LGTRIP3546-6HIS nucleotide
(SEQ ID NO: 747)
ATGAACGTGAGCGGCTGGCGGCTGTTCAAGAAGATTAGCAACGGCTCGAG
CGGTTCGTTCACACTCGACGATTTCGTTGGGGACTGGGAACAGACAGCCG
CCTACAACCTGGACCAAGTCCTTGAACAGGGAGGTGTGTCCAGTTTGCTG
CAGAATCTCGCCGTGTCCGTAACTCCGATCATGAGGATTGTCCGGAGCGG
TGAAAATGCCCTGAAGATCGACATCCATGTCATCATCCCGTATGAAGGTC
TGAGCGCCGACCAAATGGCCCAGATCGAAGAGGTGTTTAAGGTGGTGTAC
CCTGTGGATGATCATCACTTTAAGGTGATCCTGCCCTATGGCACACTGGT
AATCGACGGGGTTACGCCGAACAAGCTGAACTATTTCGGACGGCCGTATG
AAGGCATCGCCGTGTTCGACGGCAAAAAGATCACTACCACAGGGACCCTG
TGGAACGGCAACAAAATTATCGACGAGCGCCTGATCACCCCCGACCATCA
CCATCACCATCAT ATG-5485 PEP78-5GS-LGTRIP3546-6HIS amino acid
(SEQ ID NO: 748)
MNVSGWRLFKKISNGSSGSGSFTLDDFVGDWEQTAAYNLDQVLEQGGVSSLL
QNLAVSVTPIMRIVRSGENALKIDIHVIIPYEGLSADQMAQIEEVFKVVY
PVDDHHFKVILPYGTLVIDGVTPNKLNYFGRPYEGIAVFDGKKITTTGTL
WNGNKIIDERLITPDHHHHHH ATG-5486 PEP78-6GS-LGTRIP3546-6HIS nucleotide
(SEQ ID NO: 749)
ATGAACGTGAGCGGCTGGCGGCTGTTCAAGAAGATTAGCAACGGCTCGAG
CGGTGGCTCGTTCACACTCGACGATTTCGTTGGGGACTGGGAACAGACAG
CCGCCTACAACCTGGACCAAGTCCTTGAACAGGGAGGTGTGTCCAGTTTG
CTGCAGAATCTCGCCGTGTCCGTAACTCCGATCATGAGGATTGTCCGGAG
CGGTGAAAATGCCCTGAAGATCGACATCCATGTCATCATCCCGTATGAAG
GTCTGAGCGCCGACCAAATGGCCCAGATCGAAGAGGTGTTTAAGGTGGTG
TACCCTGTGGATGATCATCACTTTAAGGTGATCCTGCCCTATGGCACACT
GGTAATCGACGGGGTTACGCCGAACAAGCTGAACTATTTCGGACGGCCGT
ATGAAGGCATCGCCGTGTTCGACGGCAAAAAGATCACTACCACAGGGACC
CTGTGGAACGGCAACAAAATTATCGACGAGCGCCTGATCACCCCCGACCA
TCACCATCACCATCAT ATG-5486 PEP78-6GS-LGTRIP3546-6HIS amino acid
(SEQ ID NO: 750)
MNVSGWRLFKKISNGSSGGSFTLDDFVGDWEQTAAYNLDQVLEQGGVSSL
LQNLAVSVTPIMRIVRSGENALKIDIHVIIPYEGLSADQMAQIEEVFKVV
YPVDDHHFKVILPYGTLVIDGVTPNKLNYFGRPYEGIAVFDGKKITTTGT
LWNGNKIIDERLITPDHHHHHH ATG-5487 PEP78-7GS-LGTRIP3546-6HIS nucleotide
(SEQ ID NO: 751)
ATGAACGTGAGCGGCTGGCGGCTGTTCAAGAAGATTAGCAACGGCTCGAG
CGGTGGCTCGGGTTTCACACTCGACGATTTCGTTGGGGACTGGGAACAGA
CAGCCGCCTACAACCTGGACCAAGTCCTTGAACAGGGAGGTGTGTCCAGT
TTGCTGCAGAATCTCGCCGTGTCCGTAACTCCGATCATGAGGATTGTCCG
GAGCGGTGAAAATGCCCTGAAGATCGACATCCATGTCATCATCCCGTATG
AAGGTCTGAGCGCCGACCAAATGGCCCAGATCGAAGAGGTGTTTAAGGTG
GTGTACCCTGTGGATGATCATCACTTTAAGGTGATCCTGCCCTATGGCAC
ACTGGTAATCGACGGGGTTACGCCGAACAAGCTGAACTATTTCGGACGGC
CGTATGAAGGCATCGCCGTGTTCGACGGCAAAAAGATCACTACCACAGGG
ACCCTGTGGAACGGCAACAAAATTATCGACGAGCGCCTGATCACCCCCGA
CCATCACCATCACCATCAT ATG-5487 PEP78-7GS-LGTRIP3546-6HIS amino acid
(SEQ ID NO: 752)
MNVSGWRLFKKISNGSSGGSGFTLDDFVGDWEQTAAYNLDQVLEQGGVSS
LLQNLAVSVTPIMRIVRSGENALKIDIHVIIPYEGLSADQMAQIEEVFKV
VYPVDDHHFKVILPYGTLVIDGVTPNKLNYFGRPYEGIAVFDGKKITTTG
TLWNGNKIIDERLITPDHHHHHH ATG-5488 PEP78-9GS-LGTRIP3546-6HIS nucleotide
(SEQ ID NO: 753)
ATGAACGTGAGCGGCTGGCGGCTGTTCAAGAAGATTAGCAACGGCTCGAG
CGGTGGCTCGAGCGGTGGTTTCACACTCGACGATTTCGTTGGGGACTGGG
AACAGACAGCCGCCTACAACCTGGACCAAGTCCTTGAACAGGGAGGTGTG
TCCAGTTTGCTGCAGAATCTCGCCGTGTCCGTAACTCCGATCATGAGGAT
TGTCCGGAGCGGTGAAAATGCCCTGAAGATCGACATCCATGTCATCATCC
CGTATGAAGGTCTGAGCGCCGACCAAATGGCCCAGATCGAAGAGGTGTTT
AAGGTGGTGTACCCTGTGGATGATCATCACTTTAAGGTGATCCTGCCCTA
TGGCACACTGGTAATCGACGGGGTTACGCCGAACAAGCTGAACTATTTCG
GACGGCCGTATGAAGGCATCGCCGTGTTCGACGGCAAAAAGATCACTACC
ACAGGGACCCTGTGGAACGGCAACAAAATTATCGACGAGCGCCTGATCAC
CCCCGACCATCACCATCACCATCAT ATG-5488 PEP78-9GS-LGTRIP3546-6HIS amino acid
(SEQ ID NO: 754)
MNVSGWRLFKKISNGSSGGSSGGFTLDDFVGDWEQTAAYNLDQVLEQGGV
SSLLQNLAVSVTPIMRIVRSGENALKIDIHVIIPYEGLSADQMAQIEEVF
KVVYPVDDHHFKVILPYGTLVIDGVTPNKLNYFGRPYEGIAVFDGKKITT
TGTLWNGNKIIDERLITPDHHHHHH ATG-5489 PEP78-10GS-LGTRIP3546-6HIS nucleotide
(SEQ ID NO: 755)
ATGAACGTGAGCGGCTGGCGGCTGTTCAAGAAGATTAGCAACGGCTCGAG
CGGTGGCTCGAGCGGTGGTAGCTTCACACTCGACGATTTCGTTGGGGACT
GGGAACAGACAGCCGCCTACAACCTGGACCAAGTCCTTGAACAGGGAGGT
GTGTCCAGTTTGCTGCAGAATCTCGCCGTGTCCGTAACTCCGATCATGAG
GATTGTCCGGAGCGGTGAAAATGCCCTGAAGATCGACATCCATGTCATCA
TCCCGTATGAAGGTCTGAGCGCCGACCAAATGGCCCAGATCGAAGAGGTG

```
TTTAAGGTGGTGTACCCTGTGGATGATCATCACTTTAAGGTGATCCTGCC

CTATGGCACACTGGTAATCGACGGGGTTACGCCGAACAAGCTGAACTATT

TCGGACGGCCGTATGAAGGCATCGCCGTGTTCGACGGCAAAAAGATCACT

ACCACAGGGACCCTGTGGAACGGCAACAAAATTATCGACGAGCGCCTGAT

CACCCCCGACCATCACCATCACCATCAT
```

ATG-5489 PEP78-10GS-LGTRIP3546-6HIS amino acid
(SEQ ID NO: 756)
```
MNVSGWRLFKKISNGSSGGSSGGSFTLDDFVGDWEQTAAYNLDQVLEQGG

VSSLLQNLAVSVTPIMRIVRSGENALKIDIHVIIPYEGLSADQMAQIEEV

FKVVYPVDDHHFKVILPYGTLVIDGVTPNKLNYFGRPYEGIAVFDGKKIT

TTGTLWNGNKIIDERLITPDHHHHHH
```

ATG-5490 PEP78-11GS-LGTRIP3546-6HIS nucleotide
(SEQ ID NO: 757)
```
ATGAACGTGAGCGGCTGGCGGCTGTTCAAGAAGATTAGCAACGGCTCGAG

CGGTGGCTCGAGCGGTGGTAGCTCGTTCACACTCGACGATTTCGTTGGGG

ACTGGGAACAGACAGCCGCCTACAACCTGGACCAAGTCCTTGAACAGGGA

GGTGTGTCCAGTTTGCTGCAGAATCTCGCCGTGTCCGTAACTCCGATCAT

GAGGATTGTCCGGAGCGGTGAAAATGCCCTGAAGATCGACATCCATGTCA

TCATCCCGTATGAAGGTCTGAGCGCCGACCAAATGGCCCAGATCGAAGAG

GTGTTTAAGGTGGTGTACCCTGTGGATGATCATCACTTTAAGGTGATCCT

GCCCTATGGCACACTGGTAATCGACGGGGTTACGCCGAACAAGCTGAACT

ATTTCGGACGGCCGTATGAAGGCATCGCCGTGTTCGACGGCAAAAAGATC

ACTACCACAGGGACCCTGTGGAACGGCAACAAAATTATCGACGAGCGCCT

GATCACCCCCGACCATCACCATCACCATCAT
```

ATG-5490 PEP78-11GS-LGTRIP3546-6HIS amino acid
(SEQ ID NO: 758)
```
MNVSGWRLFKKISNGSSGGSSGGSSFTLDDFVGDWEQTAAYNLDQVLEQG

GVSSLLQNLAVSVTPIMRIVRSGENALKIDIHVIIPYEGLSADQMAQIEE

VFKVVYPVDDHHFKVILPYGTLVIDGVTPNKLNYFGRPYEGIAVFDGKKI

TTTGTLWNGNKIIDERLITPDHHHHHH
```

ATG-5513 4992 + R112H + K123E nucleotide
(SEQ ID NO: 759)
```
ATGAACGTGAGCGGCTGGCGGCTGTTCAAGAAGATTAGCAACGGCTCGAG

CGGTGGCTCGAGCGGTTTCACACTCGACGATTTCGTTGGGGACTGGGAAC

AGACAGCCGCCTACAACCTGGACCAAGTCCTTGAACAGGGAGGTGTGTCC

AGTTTGCTGCAGAATCTCGCCGTGTCCGTAACTCCGATCATGAGGATTGT

CCGGAGCGGTGAAAATGCCCTGAAGATCGACATCCATGTCATCATCCCGT

ATGAAGGTCTGAGCGCCGACCAAATGGCCCAGATCGAAGAGGTGTTTAAG

GTGGTGTACCCTGTGGATGATCATCACTTTAAGGTGATCCTGCCCTATGG

CACACTGGTAATCGACGGGGTTACGCCGAACAAGCTGAACTATTTCGGAC

ACCCGTATGAAGGCATCGCCGTGTTCGACGGCGAGAAGATCACTACCACA

GGGACCCTGTGGAACGGCAACAAAATTATCGACGAGCGCCTGATCACCCC

CGACCATCACCATCACCATCAT
```

ATG-5513 4992 + R112H + K123E amino acid
(SEQ ID NO: 760)
```
MNVSGWRLFKKISNGSSGGSSGFTLDDFVGDWEQTAAYNLDQVLEQGGVS

SLLQNLAVSVTPIMRIVRSGENALKIDIHVIIPYEGLSADQMAQIEEVFK

VVYPVDDHHFKVILPYGTLVIDGVTPNKLNYFGHPYEGIAVFDGEKITTT

GTLWNGNKIIDERLITPDHHHHHH
```

ATG-5514 4992 + R112H + T144D nucleotide
(SEQ ID NO: 761)
```
ATGAACGTGAGCGGCTGGCGGCTGTTCAAGAAGATTAGCAACGGCTCGAG

CGGTGGCTCGAGCGGTTTCACACTCGACGATTTCGTTGGGGACTGGGAAC

AGACAGCCGCCTACAACCTGGACCAAGTCCTTGAACAGGGAGGTGTGTCC

AGTTTGCTGCAGAATCTCGCCGTGTCCGTAACTCCGATCATGAGGATTGT

CCGGAGCGGTGAAAATGCCCTGAAGATCGACATCCATGTCATCATCCCGT

ATGAAGGTCTGAGCGCCGACCAAATGGCCCAGATCGAAGAGGTGTTTAAG

GTGGTGTACCCTGTGGATGATCATCACTTTAAGGTGATCCTGCCCTATGG

CACACTGGTAATCGACGGGGTTACGCCGAACAAGCTGAACTATTTCGGAC

ACCCGTATGAAGGCATCGCCGTGTTCGACGGCAAAAAGATCACTACCACA

GGGACCCTGTGGAACGGCAACAAAATTATCGACGAGCGCCTGATCGATCC

CGACCATCACCATCACCATCAT
```

ATG-5514 4992 + R112H + T144D amino acid
(SEQ ID NO: 762)
```
MNVSGWRLFKKISNGSSGGSSGFTLDDFVGDWEQTAAYNLDQVLEQGGVS

SLLQNLAVSVTPIMRIVRSGENALKIDIHVIIPYEGLSADQMAQIEEVFK

VVYPVDDHHFKVILPYGTLVIDGVTPNKLNYFGHPYEGIAVFDGKKITTT

GTLWNGNKIIDERLIDPDHHHHHH
```

ATG-5515 4992 + R112H + K123E + T144D nucleotide
(SEQ ID NO: 763)
```
ATGAACGTGAGCGGCTGGCGGCTGTTCAAGAAGATTAGCAACGGCTCGAG

CGGTGGCTCGAGCGGTTTCACACTCGACGATTTCGTTGGGGACTGGGAAC

AGACAGCCGCCTACAACCTGGACCAAGTCCTTGAACAGGGAGGTGTGTCC

AGTTTGCTGCAGAATCTCGCCGTGTCCGTAACTCCGATCATGAGGATTGT

CCGGAGCGGTGAAAATGCCCTGAAGATCGACATCCATGTCATCATCCCGT

ATGAAGGTCTGAGCGCCGACCAAATGGCCCAGATCGAAGAGGTGTTTAAG

GTGGTGTACCCTGTGGATGATCATCACTTTAAGGTGATCCTGCCCTATGG

CACACTGGTAATCGACGGGGTTACGCCGAACAAGCTGAACTATTTCGGAC

ACCCGTATGAAGGCATCGCCGTGTTCGACGGCGAGAAGATCACTACCACA

GGGACCCTGTGGAACGGCAACAAAATTATCGACGAGCGCCTGATCGATCC

CGACCATCACCATCACCATCAT
```

ATG-5515 4992 + R112H + K123E + T144D amino acid
(SEQ ID NO: 764)
```
MNVSGWRLFKKISNGSSGGSSGFTLDDFVGDWEQTAAYNLDQVLEQGGVS

SLLQNLAVSVTPIMRIVRSGENALKIDIHVIIPYEGLSADQMAQIEEVFK

VVYPVDDHHFKVILPYGTLVIDGVTPNKLNYFGHPYEGIAVFDGEKITTT

GTLWNGNKIIDERLIDPDHHHHHH
```

ATG-5516 5490 + R112H + K123E nucleotide
(SEQ ID NO: 765)
```
ATGAACGTGAGCGGCTGGCGGCTGTTCAAGAAGATTAGCAACGGCTCGAG

CGGTGGCTCGAGCGGTGGTAGCTCGTTCACACTCGACGATTTCGTTGGGG
```

ACTGGGAACAGACAGCCGCCTACAACCTGGACCAAGTCCTTGAACAGGGA

GGTGTGTCCAGTTTGCTGCAGAATCTCGCCGTGTCCGTAACTCCGATCAT

GAGGATTGTCCGGAGCGGTGAAAATGCCCTGAAGATCGACATCCATGTCA

TCATCCCGTATGAAGGTCTGAGCGCCGACCAAATGGCCCAGATCGAAGAG

GTGTTTAAGGTGGTGTACCCTGTGGATGATCATCACTTTAAGGTGATCCT

GCCCTATGGCACACTGGTAATCGACGGGGTTACGCCGAACAAGCTGAACT

ATTTCGGACACCCGTATGAAGGCATCGCCGTGTTCGACGGCGAGAAGATC

ACTACCACAGGGACCCTGTGGAACGGCAACAAAATTATCGACGAGCGCCT

GATCACCCCCGACCATCACCATCACCATCAT

ATG-5516 5490 + R112H + K123E amino acid
(SEQ ID NO: 766)
MNVSGWRLFKKISNGSSGGSSGGSSFTLDDFVGDWEQTAAYNLDQVLEQG

GVSSLLQNLAVSVTPIMRIVRSGENALKIDIHVIIPYEGLSADQMAQIEE

VFKVVYPVDDHHFKVILPYGTLVIDGVTPNKLNYFGHPYEGIAVFDGEKI

TTTGTLWNGNKIIDERLITPDHHHHHH

ATG-5517 5490 + R112H + K123E + T144D nucleotide
(SEQ ID NO: 767)
ATGAACGTGAGCGGCTGGCGGCTGTTCAAGAAGATTAGCAACGGCTCGAG

CGGTGGCTCGAGCGGTGGTAGCTCGTTCACACTCGACGATTTCGTTGGGG

ACTGGGAACAGACAGCCGCCTACAACCTGGACCAAGTCCTTGAACAGGGA

GGTGTGTCCAGTTTGCTGCAGAATCTCGCCGTGTCCGTAACTCCGATCAT

GAGGATTGTCCGGAGCGGTGAAAATGCCCTGAAGATCGACATCCATGTCA

TCATCCCGTATGAAGGTCTGAGCGCCGACCAAATGGCCCAGATCGAAGAG

GTGTTTAAGGTGGTGTACCCTGTGGATGATCATCACTTTAAGGTGATCCT

GCCCTATGGCACACTGGTAATCGACGGGGTTACGCCGAACAAGCTGAACT

ATTTCGGACACCCGTATGAAGGCATCGCCGTGTTCGACGGCGAGAAGATC

ACTACCACAGGGACCCTGTGGAACGGCAACAAAATTATCGACGAGCGCCT

GATCGATCCCGACCATCACCATCACCATCAT

ATG-5517 5490 + R112H + K123E + T144D amino acid
(SEQ ID NO: 768)
MNVSGWRLFKKISNGSSGGSSGGSSFTLDDFVGDWEQTAAYNLDQVLEQG

GVSSLLQNLAVSVTPIMRIVRSGENALKIDIHVIIPYEGLSADQMAQIEE

VFKVVYPVDDHHFKVILPYGTLVIDGVTPNKLNYFGHPYEGIAVFDGEKI

TTTGTLWNGNKIIDERLIDPDHHHHHH

ATG-5810 Nucleotide
(SEQ ID NO: 769)
ATGGTCTTCACACTCGAAGATTTCGTTGGGGACTGGAAGCAGACAGCCGC

CTACAACCTGGACCAAGTCCTTGAACAGGGAGGTGTGTCCAGTTTGCTGC

AGAATCTCGCCGTGTCCGTAACTCCGATCCAAAGGATGGTCCGGAGCGGT

GAAAATGCCCTGAAGATCGACATCCATGTCATCATCCCGTATGAAGGTCT

GAGCGCCGACCAAATGGCCCAGATCGAAGAGGTGTTTAAGGTGGTGTACC

CTGTGGATGATCATCACTTTAAGGTGATCCTGCACTATGGCACACTGGTA

ATCGACGGGGTTACGCCGAACATGCTGAACTATTTCGGACGGCCGTATGA

AGGCATCGCCGTGTTCGACGGCAAAAAGATCACTGTAACAGGGACCCTGT

GGAACGGCGCCAAAATTATCGACGAGCGCCTGATCACCCCCGACGGCTCC

ATGTCCTTCCAGGTAACCATCAACAGC

ATG-5810 Amino Acid
(SEQ ID NO: 770)
MVFTLEDFVGDWKQTAAYNLDQVLEQGGVSSLLQNLAVSVTPIQRMVRSG

ENALKIDIHVIIPYEGLSADQMAQIEEVFKVVYPVDDHHFKVILHYGTLV

IDGVTPNMLNYFGRPYEGIAVFDGKKITVTGTLWNGAKIIDERLITPDGS

MSFQVTINS

ATG-5819 Nucleotide
(SEQ ID NO: 771)
ATGGTCTTCACACTCGAAGATTTCGTTGGGGACTGGAAGCAGACAGCCGC

CTACAACCTGGACCAAGTCCTTGAACAGGGAGGTGTGTCCAGTTTGCTGC

AGAATCTCGCCGTGTCCGTAACTCCGATCCAAAGGATAGTCCGGAGCGGT

GAAAATGCCCTGAAGATCGACATCCATGTCATCATCCCGTATGAAGGTCT

GAGCGCCGACCAAATGGCCCAGATCGAAGAGGTGTTTAAGGTGGTGTACC

CTGTGGATGATCATCACTTTAAGGTGATCCTGCACTATGGCACACTGGTA

ATCGACGGGGTTACGCCGAACATGCTGAACTATTTCGGACGGCCGTATGA

AGGCATCGCCGTGTTCGACGGCAAAAAGATCACTGTAACAGGGACCCTGT

GGAACGGCGCCAAAATTATCGACGAGCGCCTGATCACCCCCGACGGCTCC

ATGTCCTTCCAGGTAACCATCAACAGC

ATG-5819 Amino Acid
(SEQ ID NO: 772)
MVFTLEDFVGDWKQTAAYNLDQVLEQGGVSSLLQNLAVSVTPIQRIVRSG

ENALKIDIHVIIPYEGLSADQMAQIEEVFKVVYPVDDHHFKVILHYGTLV

IDGVTPNMLNYFGRPYEGIAVFDGKKITVTGTLWNGAKIIDERLITPDGS

MSFQVTINS

ATG-5820 Nucleotide
(SEQ ID NO: 773)
ATGGTCTTCACACTCGAAGATTTCGTTGGGGACTGGAAGCAGACAGCCGC

CTACAACCTGGACCAAGTCCTTGAACAGGGAGGTGTGTCCAGTTTGCTGC

AGAATCTCGCCGTGTCCGTAACTCCGATCCAAAGGGTGGTCCGGAGCGGT

GAAAATGCCCTGAAGATCGACATCCATGTCATCATCCCGTATGAAGGTCT

GAGCGCCGACCAAATGGCCCAGATCGAAGAGGTGTTTAAGGTGGTGTACC

CTGTGGATGATCATCACTTTAAGGTGATCCTGCACTATGGCACACTGGTA

ATCGACGGGGTTACGCCGAACATGCTGAACTATTTCGGACGGCCGTATGA

AGGCATCGCCGTGTTCGACGGCAAAAAGATCACTGTAACAGGGACCCTGT

GGAACGGCGCCAAAATTATCGACGAGCGCCTGATCACCCCCGACGGCTCC

ATGTCCTTCCAGGTAACCATCAACAGC

ATG-5820 Amino Acid
(SEQ ID NO: 774)
MVFTLEDFVGDWKQTAAYNLDQVLEQGGVSSLLQNLAVSVTPIQRVVRSG

ENALKIDIHVIIPYEGLSADQMAQIEEVFKVVYPVDDHHFKVILHYGTLV

IDGVTPNMLNYFGRPYEGIAVFDGKKITVTGTLWNGAKIIDERLITPDGS

MSFQVTINS

ATG-5821 Nucleotide
(SEQ ID NO: 775)
ATGGTCTTCACACTCGAAGATTTCGTTGGGGACTGGAAGCAGACAGCCGC

```
CTACAACCTGGACCAAGTCCTTGAACAGGGAGGTGTGTCCAGTTTGCTGC
AGAATCTCGCCGTGTCCGTAACTCCGATCCAAAGGTTTGTCCGGAGCGGT
GAAAATGCCCTGAAGATCGACATCCATGTCATCATCCCGTATGAAGGTCT
GAGCGCCGACCAAATGGCCCAGATCGAAGAGGTGTTTAAGGTGGTGTACC
CTGTGGATGATCATCACTTTAAGGTGATCCTGCACTATGGCACACTGGTA
ATCGACGGGGTTACGCCGAACATGCTGAACTATTTCGGACGGCCGTATGA
AGGCATCGCCGTGTTCGACGGCAAAAAGATCACTGTAACAGGGACCCTGT
GGAACGGCGCCAAAATTATCGACGAGCGCCTGATCACCCCCGACGGCTCC
ATGTCCTTCCAGGTAACCATCAACAGC
```

ATG-5821 Amino Acid
(SEQ ID NO: 776)
MVFTLEDFVGDWKQTAAYNLDQVLEQGGVSSLLQNLAVSVTPIQRFVRSG
ENALKIDIHVIIPYEGLSADQMAQIEEVFKVVYPVDDHHFKVILHYGTLV
IDGVTPNMLNYFGRPYEGIAVFDGKKITVTGTLWNGAKIIDERLITPDGS
MSFQVTINS ATG-5822 Nucleotide
(SEQ ID NO: 777)
```
ATGGTCTTCACACTCGAAGATTTCGTTGGGGACTGGAAGCAGACAGCCGC
CTACAACCTGGACCAAGTCCTTGAACAGGGAGGTGTGTCCAGTTTGCTGC
AGAATCTCGCCGTGTCCGTAACTCCGATCCAAAGGCTGGTCCGGAGCGGT
GAAAATGCCCTGAAGATCGACATCCATGTCATCATCCCGTATGAAGGTCT
GAGCGCCGACCAAATGGCCCAGATCGAAGAGGTGTTTAAGGTGGTGTACC
CTGTGGATGATCATCACTTTAAGGTGATCCTGCACTATGGCACACTGGTA
ATCGACGGGGTTACGCCGAACATGCTGAACTATTTCGGACGGCCGTATGA
AGGCATCGCCGTGTTCGACGGCAAAAAGATCACTGTAACAGGGACCCTGT
GGAACGGCGCCAAAATTATCGACGAGCGCCTGATCACCCCCGACGGCTCC
ATGTCCTTCCAGGTAACCATCAACAGC
```

ATG-5822 Amino Acid
(SEQ ID NO: 778)
MVFTLEDFVGDWKQTAAYNLDQVLEQGGVSSLLQNLAVSVTPIQRLVRSG
ENALKIDIHVIIPYEGLSADQMAQIEEVFKVVYPVDDHHFKVILHYGTLV
IDGVTPNMLNYFGRPYEGIAVFDGKKITVTGTLWNGAKIIDERLITPDGS
MSFQVTINS Monomeric LgBiT sequences:
ATG-5872 Nucleotide
(SEQ ID NO: 779)
```
Atgaaacatcaccatcaccatcatgcgatcgccatggtcttcacactcga
cgatttcgttggggactgggaacagacagccgcctacaacctggaccaag
tccttgaacagggaggtgtgtccagtttgctgcagaatctcgccgtgtcc
gtaactccgatccaaaggattgtccggagcggtgaaaatgccctgaagat
cgacatccatgtcatcatcccgtatgaaggtctgagcgccgaccaaatgg
cccagatcgaagaggtgtttaaggtggtgtaccctgtggatgatcatcac
tttaaggtgatcctgccctatggcacactggtaatcgacggggttacgcc
gaacaagctgaactatttcggacacccgtatgaaggcatcgccgtgttcg
acggcgagaagatcactgtaacagggaccctgtggaacggcaacaaaatt
atcgacgagcgcctgatcacccccgacggctccatgctgttccgagtaac
catcaacgcgttagcggctggcgcctgttcaagaagatcagc
```

ATG-5872 Amino Acid
(SEQ ID NO: 780)
MKHHHHHHAIAMVFTLDDFVGDWEQTAAYNLDQVLEQGGVSSLLQNLAVS
VTPIQRIVRSGENALKIDIHVIIPYEGLSADQMAQIEEVFKVVYPVDDHH
FKVILPYGTLVIDGVTPNKLNYFGHPYEGIAVFDGEKITVTGTLWNGNKI
IDERLITPDGSMLFRVTINGVSGWRLFKKIS ATG-5873 Nucleotide
(SEQ ID NO: 781)
```
atgaaacatcaccatcaccatcatgcgatcgccatggatttcacactcga
cgatttcgttggggactgggaacagacagccgcctacaacctggaccaag
tccttgaacagggaggtgtgtccagtttgctgcagaatctcgccgtgtcc
gtaactccgatccaaaggattgtccggagcggtgaaaatgccctgaagat
cgacatccatgtcatcatcccgtatgaaggtctgagcgccgaccaaatgg
cccagatcgaagaggtgtttaaggtggtgtaccctgtggatgatcatcac
tttaaggtgatcctgccctatggcacactggtaatcgacggggttacgcc
gaacaagctgaactatttcggacggccgtatgaaggcatcgccgtgttcg
acggcgagaagatcactgtaacagggaccctgtggaacggcaacaaaatt
atcgacgagcgcctgatcacccccgacggctccatgctgttccgagtaac
catcaacgcgttagcggctggcgcctgttcaagaagatcagc
```

ATG-5873 Amino Acid
(SEQ ID NO: 782)
MKHHHHHHAIAMDFTLDDFVGDWEQTAAYNLDQVLEQGGVSSLLQNLAVS
VTPIQRIVRSGENALKIDIHVIIPYEGLSADQMAQIEEVFKVVYPVDDHH
FKVILPYGTLVIDGVTPNKLNYFGRPYEGIAVFDGEKITVTGTLWNGNKI
IDERLITPDGSMLFRVTINGVSGWRLFKKIS ATG-5874 Nucleotide
(SEQ ID NO: 783)
```
atgaaacatcaccatcaccatcatgcgatcgccatggatttcacactcga
cgatttcgttggggactgggaacagacagccgcctacaacctggaccaag
tccttgaacagggaggtgtgtccagtttgctgcagaatctcgccgtgtcc
gtaactccgatccaaaggattgtccggagcggtgaaaatgccctgaagat
cgacatccatgtcatcatcccgtatgaaggtctgagcgccgaccaaatgg
cccagatcgaagaggtgtttaaggtggtgtaccctgtggatgatcatcac
tttaaggtgatcctgccctatggcacactggtaatcgacggggttacgcc
gaacaagctgaactatttcggacacccgtatgaaggcatcgccgtgttcg
acggcaaaaagatcactgtaacagggaccctgtggaacggcaacaaaatt
atcgacgagcgcctgatcacccccgacggctccatgctgttccgagtaac
catcaacgcgttagcggctggcgcctgttcaagaagatcagc
```

ATG-5874 Amino Acid
(SEQ ID NO: 784)
MKHHHHHHAIAMDFTLDDFVGDWEQTAAYNLDQVLEQGGVSSLLQNLAVS
VTPIQRIVRSGENALKIDIHVIIPYEGLSADQMAQIEEVFKVVYPVDDHH
FKVILPYGTLVIDGVTPNKLNYFGHPYEGIAVFDGKKITVTGTLWNGNKI
IDERLITPDGSMLFRVTINGVSGWRLFKKIS ATG-5875 Nucleotide
(SEQ ID NO: 785)
Atgaaacatcaccatcaccatcatgcgatcgccatggatttcacactcga
cgatttcgttggggactgggaacagacagccgcctacaacctggaccaag
tccttgaacagggaggtgtgtccagtttgctgcagaatctcgccgtgtcc
gtaactccgatccaaaggattgtccggagcggtgaaaatgccctgaagat
cgacatccatgtcatcatcccgtatgaaggtctgagcgccgaccaaatgg
cccagatcgaagaggtgtttaaggtggtgtaccctgtggatgatcatcac
tttaaggtgatcctgccctatggcacactggtaatcgacggggttacgcc
gaacatgctgaactatttcggacaccgtatgaaggcatcgccgtgttcg
acggcgagaagatcactgtaacagggaccctgtggaacggcaacaaaatt
atcgacgagcgcctgatcaccccgacggctccatgctgttccgagtaac
catcaacggcgttagcggctggcgcctgttcaagaagatcagc
ATG-5875 Amino Acid
(SEQ ID NO: 786)
MKHHHHHHAIAMDFTLDDFVGDWEQTAAYNLDQVLEQGGVSSLLQNLAVS
VTPIQRIVRSGENALKIDIHVIIPYEGLSADQMAQIEEVFKVVYPVDDHH
FKVILPYGTLVIDGVTPNMLNYFGHPYEGIAVFDGEKITVTGTLWNGNKI
IDERLITPDGSMLFRVTINGVSGWRLFKKIS
ATG-5876 Nucleotide
(SEQ ID NO: 787)
Atgaaacatcaccatcaccatcatgcgatcgccatggatttcacactcga
agatttcgttggggactgggaacagacagccgcctacaacctggaccaag
tccttgaacagggaggtgtgtccagtttgctgcagaatctcgccgtgtcc
gtaactccgatccaaaggattgtccggagcggtgaaaatgccctgaagat
cgacatccatgtcatcatcccgtatgaaggtctgagcgccgaccaaatgg
cccagatcgaagaggtgtttaaggtggtgtaccctgtggatgatcatcac
tttaaggtgatcctgccctatggcacactggtaatcgacggggttacgcc
gaacaagctgaactatttcggacaccgtatgaaggcatcgccgtgttcg
acggcgagaagatcactgtaacagggaccctgtggaacggcaacaaaatt
atcgacgagcgcctgatcaccccgacggctccatgctgttccgagtaac
catcaacggcgttagcggctggcgcctgttcaagaagatcagc
ATG-5876 Amino Acid
(SEQ ID NO: 802)
MKHHHHHHAIAMDFTLEDFVGDWEQTAAYNLDQVLEQGGVSSLLQNLAVS
VTPIQRIVRSGENALKIDIHVIIPYEGLSADQMAQIEEVFKVVYPVDDHH
FKVILPYGTLVIDGVTPNKLNYFGHPYEGIAVFDGEKITVTGTLWNGNKI
IDERLITPDGSMLFRVTINGVSGWRLFKKIS
ATG-5877 Nucleotide
(SEQ ID NO: 803)
Atgaaacatcaccatcaccatcatgcgatcgccatggatttcacactcga
cgatttcgttggggactgggaacagacagccgcctacaacctggaccaag
tccttgaacagggaggtgtgtccagtttgctgcagaatctcgccgtgtcc
gtaactccgatccaaaggattgtccggagcggtgaaaatgccctgaagat
cgacatccatgtcatcatcccgtatgaaggtctgagcgccgaccaaatgg
cccagatcgaagaggtgtttaaggtggtgtaccctgtggatgatcatcac
tttaaggtgatcctgccctatggcacactggtaatcgacggggttacgcc
gaacaagctgaactatttcggacaccgtatgaaggcatcgccgtgttcg
acggcgagaagatcactgtaacagggaccctgtggaacggcaacaaaatt
atcgacgagcgcctgatcaccccgacggctccatgctgttccgagtaac
catcaacggcgttagcggctggcgcctgttcaagaagatcagc
ATG-5877 Amino Acid
(SEQ ID NO: 804)
MKHHHHHHAIAMDFTLDDFVGDWEQTAAYNLDQVLEQGGVSSLLQNLAVS
VTPIQRIVRSGENALKIDIHVIIPYEGLSADQMAQIEEVFKVVYPVDDHH
FKVILPYGTLVIDGVTPNKLNYFGHPYEGIAVFDGEKITVTGTLWNGNKI
IDERLITPDGSMLFRVTINGVSGWRLFKKIS
ATG-5878 Nucleotide
(SEQ ID NO: 805)
Atgaaacatcatcaccatcaccacgcagaaatcggtactggctttccatt
cgaccccattatgtggaagtcctgggcgagcgcatgcactacgtcgatg
ttggtccgcgcgatggcaccctgtgctgttcctgcacggtaacccgacc
tcctcctacgtgtggcgcaacatcatcccgcatgttgcaccgacccatcg
ctgcattgctccagacctgatcggtatgggcaaatccgacaaaccagacc
tgggttatttcttcgacgaccacgtccgcttcatggatgccttcatcgaa
gccctgggtctggaagaggtcgtcctggtcattcacgactgggctccgc
tctgggtttccactgggccaagcgcaatccagagcgcgtcaaaggtattg
catttatggagttcatccgccctatcccgacctgggacgaatggccagaa
tttgcccgcgagaccttccaggccttccgcaccaccgacgtcggccgcaa
gctgatcatcgatcagaacgttttatcgagggtacgctgccgatgggtg
tcgtccgcccgctgactgaagtcgagatggaccattaccgcgagccgttc
ctgaatcctgttgaccgcgagccactgtggcgcttcccaaacgagctgcc
aatcgccggtgagccagcgaacatcgtcgcgctggtcgaagaatacatgg
actggctgcaccagtcccctgtcccgaagctgctgttctggggcacccca
ggcgttctgatcccaccggccgaagccgctcgcctggccaaaagcctgcc
taactgcaaggctgtggacatcggcccgggtctgaatctgctgcaagaag
acaacccggacctgatcggcagcgagatcgcgcgctggctgtcgacgctc
gagatttccggcgagccaaccactagcgataacggctccatgctgttccg
agtaaccatcaacagcgttagcggctggcgcctgttcaagaagatcagc
ATG-5878 Amino Acid
(SEQ ID NO: 806)
MKHHHHHHAEIGTGFPFDPHYVEVLGERMHYVDVGPRDGTPVLFLHGNPT
SSYVWRNIIPHVAPTHRCIAPDLIGMGKSDKPDLGYFFDDHVRFMDAFIE
ALGLEEVVLVIHDWGSALGFHWAKRNPERVKGIAFMEFIRPIPTWDEWPE
FARETFQAFRTTDVGRKLIIDQNVFIEGTLPMGVVRPLTEVEMDHYREPF
LNPVDREPLWRFPNELPIAGEPANIVALVEEYMDWLHQSPVPKLLFWGTP
GVLIPPAEAARLAKSLPNCKAVDIGPGLNLLQEDNPDLIGSEIARWLSTL
EISGEPTTSDNGSMLFRVTINSVSGWRLFKKIS
ATG-5879 Nucleotide (SEQ ID NO: 807)
atgaaacatcaccatcaccatcatgcgatcgccatggtcttcacactcga
agatttcgttggggactggaagcagacagccgcctacaacctggaccaag
tccttgaacagggaggtgtgtccagtttgctgcagaatctcgccgtgtcc
gtaactccgatccaaaggattgtccggagcggtgaaaatgccctgaagat
cgacatccatgtcatcatcccgtatgaaggtctgagcgccgaccaaatgg
cccagatcgaagaggtgtttaaggtggtgtaccctgtggatgatcatcac
tttaaggtgatcctgccctatggcacactggtaatcgacggggttacgcc
gaacatgctgaactatttcggacggccgtatgaaggcatcgccgtgttcg
acggcaaaaagatcactgtaacagggaccctgtggaacggcaacaaaatt
atcgacgagcgcctgatcaccccgacggctccatgctgttccgagtaac
catcaacggcgttagcggctggcgcctgttcaagaagatcagc
ATG-5879 Amino Acid
(SEQ ID NO: 808)
MKHHHHHHAIAMVFTLEDFVGDWKQTAAYNLDQVLEQGGVSSLLQNLAVS
VTPIQRIVRSGENALKIDIHVIIPYEGLSADQMAQIEEVFKVVYPVDDHH
FKVILPYGTLVIDGVTPNMLNYFGRPYEGIAVFDGKKITVTGTLWNGNKI
IDERLITPDGSMLFRVTINGVSGWRLFKKIS
ATG-5880 Nucleotide
(SEQ ID NO: 809)
atgaaacatcaccatcaccatcatgcgatcgccatggtcttcacactcga
agatttcgttggggactggcgccagacagccgcctacaacctggaccaag
tccttgaacagggaggtgtgtccagtttgctgcagaatctcgccgtgtcc
gtaactccgatccaaaggattgtccggagcggtgaaaatgccctgaagat
cgacatccatgtcatcatcccgtatgaaggtctgagcgccgaccaaatgg
cccagatcgaagaggtgtttaaggtggtgtaccctgtggatgatcatcac
tttaaggtgatcctgccctatggcacactggtaatcgacggggttacgcc
gaacatgctgaactatttcggacggccgtatgaaggcatcgccgtgttcg
acggcaaaaagatcactgtaacagggaccctgtggaacggcaacaaaatt
atcgacgagcgcctgatcaccccgacggctccatgctgttccgagtaac
catcaacggcgttagcggctggcgcctgttcaagaagatcagc
ATG-5880 Amino Acid
(SEQ ID NO: 813)
MKHHHHHHAIAMVFTLEDFVGDWRQTAAYNLDQVLEQGGVSSLLQNLAVS
VTPIQRIVRSGENALKIDIHVIIPYEGLSADQMAQIEEVFKVVYPVDDHH
FKVILPYGTLVIDGVTPNMLNYFGRPYEGIAVFDGKKITVTGTLWNGNKI
IDERLITPDGSMLFRVTINGVSGWRLFKKIS
ATG-5881 Nucleotide
(SEQ ID NO: 814)
atgaaacatcaccatcaccatcatgcgatcgccatggtcttcacactcga
agatttcgttggggactgggaacagacagccgcctacaacctggaccaag
tccttgaacagggaggtgtgtccagtttgctgcagaatctcgccgtgtcc
gtaactccgatccaaaggattgtccggagcggtgaaaatgccctgaagat
cgacatccatgtcatcatcccgtatgaaggtctgagcgccgaccaaatgg
cccagatcgaagaggtgtttaaggtggtgtaccctgtggatgatcatcac
tttaaggtgatcctgccctatggcacactggtaatcgacggggttacgcc
gaacatgctgaactatttcggacggccgttcgaaggcatcgccgtgttcg
acggcaaaaagatcactgtaacagggaccctgtggaacggcaacaaaatt
atcgacgagcgcctgatcaccccgacggctccatgctgttccgagtaac
catcaacggcgttagcggctggcgcctgttcaagaagatcagc
ATG-5881 Amino Acid
(SEQ ID NO: 815)
MKHHHHHHAIAMVFTLEDFVGDWEQTAAYNLDQVLEQGGVSSLLQNLAVS
VTPIQRIVRSGENALKIDIHVIIPYEGLSADQMAQIEEVFKVVYPVDDHH
FKVILPYGTLVIDGVTPNMLNYFGRPFEGIAVFDGKKITVTGTLWNGNKI
IDERLITPDGSMLFRVTINGVSGWRLFKKIS
ATG-5882 Nucleotide
(SEQ ID NO: 828)
atgaaacatcaccatcaccatcatgcgatcgccatggtcttcacactcga
agatttcgttggggactgggaacagacagccgcctacaacctggaccaag
tccttgaacagggaggtgtgtccagtttgctgcagaatctcgccgtgtcc
gtaactccgatccaaaggattgtccggagcggtgaaaatgccctgaagat
cgacatccatgtcatcatcccgtatgaaggtctgagcgccgaccaaatgg
cccagatcgaagaggtgtttaaggtggtgtaccctgtggatgatcatcac
tttaaggtgatcctgccctatggcacactggtaatcgacggggttacgcc
gaacatgctgaactatttcggacggccgtgggaaggcatcgccgtgttcg
acggcaaaaagatcactgtaacagggaccctgtggaacggcaacaaaatt
atcgacgagcgcctgatcaccccgacggctccatgctgttccgagtaac
catcaacggcgttagcggctggcgcctgttcaagaagatcagc
ATG-5882 Amino Acid
(SEQ ID NO: 829)
MKHHHHHHAIAMVFTLEDFVGDWEQTAAYNLDQVLEQGGVSSLLQNLAVS
VTPIQRIVRSGENALKIDIHVIIPYEGLSADQMAQIEEVFKVVYPVDDHH
FKVILPYGTLVIDGVTPNMLNYFGRPWEGIAVFDGKKITVTGTLWNGNKI
IDERLITPDGSMLFRVTINGVSGWRLFKKIS
ATG-5546 IL6-3xFlag-optRBD-15GS-SmTrip9 (840)
Nucleotide
(SEQ ID NO: 971)
atgaactccttctccacaagcgccttcggtccagttgccttctccctggg
cctgctcctggtgttgcctgctgccttccctgccccagactacaaagacc
atgacggtgattataaagatcatgacatcgattacaaggatgacgatgac
aagagagtccaacctactgaatctattgttagatttcctaatattactaa
tctttgtcctttttggcgaggtgttcaatgccaccagattcgcctctgtgt
acgcctggaaccggaagcggatcagcaattgcgtggccgactactccgtg
ctgtacaactccgccagcttcagcaccttcaagtgctacgcgcgtgtcccc
taccaagctgaacgacctgtgcttcacaaacgtgtacgccgacagcttcg
tgatccggggagatgaagtgcggcagattgcccctggacagacaggcaag
atcgccgactacaactacaagctgcccgacgacttcaccggctgtgtgat
tgcctggaacagcaacaacctggactccaaagtcggcggcaactacaatt
acctgtaccggctgttccggaagtccaatctgaagcccttcgagcgggac -continued atctccaccgagatctatcaggccggcagcacccttgtaacggcgtgga
aggcttcaactgctacttcccactgcagtcctacggctttcagcccacaa
atggcgtgggctatcagccctacagagtggtggtgctgagcttcgaactg
ctgcatgcccctgccacagtgtgcggccctaagaaaagcaccaatctcgt
gaagaacaaatgcgtgaacttcgggagctccggtggtggcgggagcggag
gtggaggctcgagcggtggcaagctcctgttcacggtaaccatcgagaag
tataag ATG-5546 Amino Acid
(SEQ ID NO: 972)
MNSFSTSAFGPVAFSLGLLLVLPAAFPAPDYKDHDGDYKDHDIDYKDDDD
KRVQPTESIVRFPNITNLCPFGEVFNATRFASVYAWNRKRISNCVADYSV
LYNSASFSTFKCYGVSPTKLNDLCFTNVYADSFVIRGDEVRQIAPGQTGK
IADYNYKLPDDFTGCVIAWNSNNLDSKVGGNYNYLYRLFRKSNLKPFERD
ISTEIYQAGSTPCNGVEGFNCYFPLQSYGFQPTNGVGYQPYRVVVLSFEL
LHAPATVCGPKKSTNLVKNKCVNFGSSGGGGSGGGGSSGGKLLFTVTIEK
YK ATG-5541 nucleotide IL6-VSHiBiT-optRBD-3xFlag
(SEQ ID NO: 973)
atgaactccttctccacaagcgccttcggtccagttgccttctccctggg cctgctcctggtgttgcctgctgccttccctgccccagtctccgtgagcg gctggcggctgttcaagaagattagcgggagctccggtggtggcgggagc ggaggtggaggctcgagcggtagagtccaacctactgaatctattgttag atttcctaatattactaatctttgtccttttggcgaggtgttcaatgcca ccagattcgcctctgtgtacgcctggaaccggaagcggatcagcaattgc gtggccgactactccgtgctgtacaactccgccagcttcagcaccttcaa gtgctacggcgtgtcccctaccaagctgaacgacctgtgcttcacaaacg tgtacgccgacagcttcgtgatccggggagatgaagtgcggcagattgcc cctggacagacaggcaagatcgccgactacaactacaagctgcccgacga cttcaccggctgtgtgattgcctggaacagcaacaacctggactccaaag tcggcggcaactacaattacctgtaccggctgttccggaagtccaatctg aagcccttcgagcgggacatctccaccgagatctatcaggccggcagcac cccttgtaacggcgtggaaggcttcaactgctacttcccactgcagtcct acggctttcagcccacaaatggcgtgggctatcagccctacagagtggtg gtgctgagcttcgaactgctgcatgcccctgccacagtgtgcggccctaa gaaaagcaccaatctcgtgaagaacaaatgcgtgaacttcgactacaaag accatgacggtgattataaagatcatgacatcgattacaaggatgacgat gacaag ATG-5541 Amino Acid (SEQ ID NO: 974)

MNSFSTSAFGPVAFSLGLLLVLPAAFPAPVSVSGWRLFKKISGSSGGGGS

GGGGSSGRVQPTESIVRFPNITNLCPFGEVFNATRFASVYAWNRKRISNC

VADYSVLYNSASFSTFKCYGVSPTKLNDLCFTNVYADSFVIRGDEVRQIA

PGQTGKIADYNYKLPDDFTGCVIAWNSNNLDSKVGGNYNYLYRLFRKSNL

KPFERDISTEIYQAGSTPCNGVEGENCYFPLQSYGFQPTNGVGYQPYRVV

-continued

VLSFELLHAPATVCGPKKSTNLVKNKCVNFDYKDHDGDYKDHDIDYKDDD

DK

ATG-5547 Nucleotide IL6-SmTrip9 (840)-optRBD-3xFlag (SEQ ID NO: 975)

atgaactccttctccacaagcgccttcggtccagttgccttctccctggg cctgctcctggtgttgcctgctgccttccctgccccaggcaagctcctgt tcacggtaaccatcgagaagtataaggggagctccggtggtgggggagcg gaggtggaggctcgagcggtagagtccaacctactgaatctattgttaga tttcctaatattactaatctttgtccttttggcgaggtgttcaatgccac cagattcgcctctgtgtacgcctggaaccggaagcggatcagcaattgcg tggccgactactccgtgctgtacaactccgccagcttcagcaccttcaag tgctacggcgtgtcccctaccaagctgaacgacctgtgcttcacaaacgt gtacgccgacagcttcgtgatccggggagatgaagtgcggcagattgccc ctggacagacaggcaagatcgccgactacaactacaagctgcccgacgac ttcaccggctgtgtgattgcctggaacagcaacaacctggactccaaagt cggcggcaactacaattacctgtaccggctgttccggaagtccaatctga agcccttcgagcgggacatctccaccgagatctatcaggccggcagcacc ccttgtaacggcgtggaaggcttcaactgctacttcccactgcagtccta cggctttcagcccacaaatggcgtgggctatcagccctacagagtggtgg tgctgagcttcgaactgctgcatgcccctgccacagtgtgcggccctaag aaaagcaccaatctcgtgaagaacaaatgcgtgaacttcgactacaaaga ccatgacggtgattataaagatcatgacatcgattacaaggatgacgatg acaag ATG-5547 Amino Acid (SEQ ID NO: 976)

MNSFSTSAFGPVAFSLGLLLVLPAAFPAPGKLLFTVTIEKYKGSSGGGGS

GGGGSSGRVQPTESIVRFPNITNLCPFGEVFNATRFASVYAWNRKRISNC

VADYSVLYNSASFSTFKCYGVSPTKLNDLCFTNVYADSFVIRGDEVRQIA

PGQTGKIADYNYKLPDDFTGCVIAWNSNNLDSKVGGNYNYLYRLFRKSNL

KPFERDISTEIYQAGSTPCNGVEGENCYFPLQSYGFQPTNGVGYQPYRVV

VLSFELLHAPATVCGPKKSTNLVKNKCVNFDYKDHDGDYKDHDIDYKDDD

ATG-5534 Nucleotide (SEQ ID NO: 977)

atggactcgggccgggacttcctgaccctgcacggcctacaggatgatga ggatctacaggcgctgctgaagggcagccagctcctgaaggtgaagtcca gctcatggaggagagagcggttctacaagttgcaggaggactgcaagacc atctggcaggagtcccgcaaggtcatgcggaccccggagtcccagctgtt ctccatcgaggacattcaggaggtgcgaatggggcaccgcacggagggtc tggagaagttcgcccgtgatgtgcccgaggaccgctgcttctccattgtc ttcaaggaccagcgcaatacactagacctcatcgccccatcgccagctga tgcccagcactgggtgctggggctgcacaagatcatccaccactcaggct ccatggaccagcgtcagaagctacagcactggattcactcctgcttgcga aaagctgacaaaaacaaggacaacaagatgagcttcaaggagctgcagaa

```
cttcctgaaggagctcaacatccagctcggctcttcaggcgcagaaatcg
gtactggctttccattcgaccccattatgtggaagtcctgggcgagcgc
atgcactacgtcgatgttggtccgcgcgatggcacccctgtgctgttcct
gcacggtaacccgacctcctcctacgtgtggcgcaacatcatcccgcatg
ttgcaccgacccatcgctgcattgctccagacctgatcggtatgggcaaa
tccgacaaaccagacctgggttatttcttcgacgaccacgtccgcttcat
ggatgccttcatcgaagccctgggtctggaagaggtcgtcctggtcattc
acgactgggctccgctctgggtttccactgggcaagcgcaatccagag
cgcgtcaaaggtattgcatttatggagttcatccgccctatcccgacctg
ggacgaatggccagaatttgcccgcgagacctccaggccttccgcacca
ccgacgtcggccgcaagctgatcatcgatcagaacgttttatcgagggt
acgctgccgatgggtgtcgtccgcccgctgactgaagtcgagatggacca
ttaccgcgagccgttcctgaatcctgttgaccgcgagccactgtggcgct
tcccaaacgagctgccaatcgccggtgagccagcgaacatcgtcgcgctg
gtcgaagaatacatggactggctgcaccagtccctgtcccgaagctgct
gttctggggcacccaggcgttctgatcctgaccggccgaagccgctcgcc
tggccaaaagcctgcctaactgcaaggctgtggacatcggcccgggtctg
aatctgctgcaagaagacaaccccggacctgatcggcagcgagatcgcgcg
ctggctgtcgacgctggagatttccggcggctcgagcggtgtcTTCACTT
TGGAAGATTTCGTGGGTGACTGGAAACAGACTGCAGCATACAACTTAGAC
CAAGTGTTGGAACAGGGTGGAGTTAGTTCGCTTTTACAGAATTTGGCAGT
TAGTGTTACGCCTATACAACGTATGGTGAGATCGGGAGAAAATGCATTAA
AAATAGACATACATGTGATAATACCTTATGAAGGATTATCGGCAGACCAA
ATGGCACAGATAGAAGAGGTTTTTAAAGTTGTTTACCCAGTTGATGATCA
TCACTTTAAAGTTATATTACACTATGGAACTTTAGTTATAGACGGTGTGA
CTCCTAACATGTTAAACTATTTCGGTAGACCTTATGAAGGAATAGCAGTT
TTCGACGGAAAGAAAATAACGGTTACTGGTACGTTATGGAACGGAGCCAA
GATAATAGACGAGAGATTAATAACGCCAGACGGAAGTATGAGTTTCCAGG
TTACGAtaaactcg
```

ATG-5534 Amino Acid
(SEQ ID NO: 978)
MDSGRDFLTLHGLQDDEDLQALLKGSQLLKVKSSSWRRERFYKLQEDCKT
IWQESRKVMRTPESQLFSIEDIQEVRMGHRTEGLEKFARDVPEDRCFSIV
FKDQRNTLDLIAPSPADAQHWVLGLHKIIHHSGSMDQRQKLQHWIHSCLR
KADKNKDNKMSFKELQNFLKELNIQLGSSGAEIGTGFPFDPHYVEVLGER
MHYVDVGPRDGTPVLFLHGNPTSSYVWRNIIPHVAPTHRCIAPDLIGMGK
SDKPDLGYFFDDHVRFMDAFIEALGLEEVVLVIHDWGSALGFHWAKRNPE
RVKGIAFMEFIRPIPTWDEWPEFARETFQAFRTTDVGRKLIIDQNVFIEG
TLPMGVVRPLTEVEMDHYREPFLNPVDREPLWRFPNELPIAGEPANIVAL
VEEYMDWLHQSPVPKLLFWGTPGVLIPPAEAARLAKSLPNCKAVDIGPGL
NLLQEDNPDLIGSEIARWLSTLEISGGSSGVFTLEDFVGDWKQTAAYNLD
QVLEQGGVSSLLQNLAVSVTPIQRMVRSGENALKIDIHVIIPYEGLSADQ
MAQIEEVFKVVYPVDDHHFKVILHYGTLVIDGVTPNMLNYFGRPYEGIAV
FDGKKITVTGTLWNGAKIIDERLITPDGSMSFQVTINS LgBiT* Amino Acid
(SEQ ID NO: 979)
MVFTLEDFVGDWKQTAAYNLDQVLEQGGVSSLLQNLAVSVTPIQRMVRSG
ENALKIDIHVIIPYEGLSADQMAQIEEVFKVVYPVDDHHFKVILHYGTLV
IDGVTPNMLNYFGRPYEGIAVFDGKKITVTGTLWNGAKIIDERLITPDGS
MSFQVTINS HaloTag®-LgBiT* Amino Acid
(SEQ ID NO: 980)
MAEIGTGFPFDPHYVEVLGERMHYVDVGPRDGTPVLFLHGNPTSSYVWRN
IIPHVAPTHRCIAPDLIGMGKSDKPDLGYFFDDHVRFMDAFIEALGLEEV
VLVIHDWGSALGFHWAKRNPERVKGIAFMEFIRPIPTWDEWPEFARETFQ
AFRTTDVGRKLIIDQNVFIEGTLPMGVVRPLTEVEMDHYREPFLNPVDRE
PLWRFPNELPIAGEPANIVALVEEYMDWLHQSPVPKLLFWGTPGVLIPPA
EAARLAKSLPNCKAVDIGPGLNLLQEDNPDLIGSEIARWLSTLEISGGSS
GVFTLEDFVGDWKQTAAYNLDQVLEQGGVSSLLQNLAVSVTPIQRMVRSG
ENALKIDIHVIIPYEGLSADQMAQIEEVFKVVYPVDDHHFKVILHYGTLV
IDGVTPNMLNYFGRPYEGIAVFDGKKITVTGTLWNGAKIIDERLITPDGS
MSFQVTINS LgBiT*-Membrane Sensor Amino Acid
(SEQ ID NO: 981)
MDSGRDFLTLHGLQDDEDLQALLKGSQLLKVKSSSWRRERFYKLQEDCKT
IWQESRKVMRTPESQLFSIEDIQEVRMGHRTEGLEKFARDVPEDRCFSIV
FKDQRNTLDLIAPSPADAQHWVLGLHKIIHHSGSMDQRQKLQHWIHSCLR
KADKNKDNKMSFKELQNFLKELNIQLGSSGAEIGTGFPFDPHYVEVLGER
MHYVDVGPRDGTPVLFLHGNPTSSYVWRNIIPHVAPTHRCIAPDLIGMGK
SDKPDLGYFFDDHVRFMDAFIEALGLEEVVLVIHDWGSALGFHWAKRNPE
RVKGIAFMEFIRPIPTWDEWPEFARETFQAFRTTDVGRKLIIDQNVFIEG
TLPMGVVRPLTEVEMDHYREPFLNPVDREPLWRFPNELPIAGEPANIVAL
VEEYMDWLHQSPVPKLLFWGTPGVLIPPAEAARLAKSLPNCKAVDIGPGL
NLLQEDNPDLIGSEIARWLSTLEISGGSSGVFTLEDFVGDWKQTAAYNLD
QVLEQGGVSSLLQNLAVSVTPIQRMVRSGENALKIDIHVIIPYEGLSADQ
MAQIEEVFKVVYPVDDHHFKVILHYGTLVIDGVTPNMLNYFGRPYEGIAV
FDGKKITVTGTLWNGAKIIDERLITPDGSMSFQVTINS LgBiT*-Nuclear Sensor Amino Acid
(SEQ ID NO: 982)
MPKKKRKVAEIGTGFPFDPHYVEVLGERMHYVDVGPRDGTPVLFLHGNPT
SSYVWRNIIPHVAPTHRCIAPDLIGMGKSDKPDLGYFFDDHVRFMDAFIE
ALGLEEVVLVIHDWGSALGFHWAKRNPERVKGIAFMEFIRPIPTWDEWPE
FARETFQAFRTTDVGRKLIIDQNVFIEGTLPMGVVRPLTEVEMDHYREPF
LNPVDREPLWRFPNELPIAGEPANIVALVEEYMDWLHQSPVPKLLFWGTP
GVLIPPAEAARLAKSLPNCKAVDIGPGLNLLQEDNPDLIGSEIARWLSTL -continued EISGGSSGVFTLEDFVGDWKQTAAYNLDQVLEQGGVSSLLQNLAVSVTPI
QRMVRSGENALKIDIHVIIPYEGLSADQMAQIEEVFKVVYPVDDHHFKVI
LHYGTLVIDGVTPNMLNYFGRPYEGIAVFDGKKITVTGTLWNGAKIIDER
LITPDGSMSFQVTINSPKKKRKVPKKKRKVPPPVSKRESKSRSRSKSPPK
SPEEEGAVSS LgBiT*-Mitochondria Sensor Amino Acid
(SEQ ID NO: 983)
MSVLTPLLLRGLTGSARRLPVPRAKIHSLGDPMSVLTPLLLRGLTGSARR
LPVPRAKIHSLGKLMSVLTPLLLRGLTGSARRLPVPRAKIHSLGDPMSVL
TPLLLRGLTGSARRLPVPRAKIHSLGKLRILQSTVPRARDPPVATMAEIG
TGFPFDPHYVEVLGERMHYVDVGPRDGTPVLFLHGNPTSSYVWRNIIPHV
APTHRCIAPDLIGMGKSDKPDLGYFFDDHVRFMDAFIEALGLEEVVLVIH
DWGSALGFHWAKRNPERVKGIAFMEFIRPIPTWDEWPEFARETFQAFRTT
DVGRKLIIDQNVFIEGTLPMGVVRPLTEVEMDHYREPFLNPVDREPLWRF
PNELPIAGEPANIVALVEEYMDWLHQSPVPKLLFWGTPGVLIPPAEAARL
AKSLPNCKAVDIGPGLNLLQEDNPDLIGSEIARWLSTLEISGGSSGVFTL
EDFVGDWKQTAAYNLDQVLEQGGVSSLLQNLAVSVTPIQRMVRSGENALK
IDIHVIIPYEGLSADQMAQIEEVFKVVYPVDDHHFKVILHYGTLVIDGVT
PNMLNYFGRPYEGIAVFDGKKITVTGTLWNGAKIIDERLITPDGSMSFQV
TINS LgBiT*-Endoplasmic Reticulum Sensor Amino Acid
(SEQ ID NO: 984)
MLLSVPLLLGLLGLAVAVFTLEDFVGDWEQTAAYNLDQVLEQGGVSSLL
QNLAVSVTPIQRIVRSGENALKIDIHVIIPYEGLSADQMAQIEEVFKVV
YPVDDHHFKVILPYGTLVIDGVTPNMLNYFGRPYEGIAVFDGKKITVTG
TLWNGNKIIDERLITPDGSMLFRVTINSGSSGMAEIGTGFPFDPHYVEV
LGERMHYVDVGPRDGTPVLFLHGNPTSSYVWRNIIPHVAPTHRCIAPDL
IGMGKSDKPDLGYFFDDHVRFMDAFIEALGLEEVVLVIHDWGSALGFHW
AKRNPERVKGIAFMEFIRPIPTWDEWPEFARETFQAFRTTDVGRKLIID
QNVFIEGTLPMGVVRPLTEVEMDHYREPFLNPVDREPLWRFPNELPIAG
EPANIVALVEEYMDWLHQSPVPKLLFWGTPGVLIPPAEAARLAKSLPNC
KAVDIGPGLNLLQEDNPDLIGSEIARWLSTLEISGKDEL LgBiT*-Golgi Sensor Amino Acid
(SEQ ID NO: 985)
MAEIGTGFPFDPHYVEVLGERMHYVDVGPRDGTPVLFLHGNPTSSYVWRN
IIPHVAPTHRCIAPDLIGMGKSDKPDLGYFFDDHVRFMDAFIEALGLEEV
VLVIHDWGSALGFHWAKRNPERVKGIAFMEFIRPIPTWDEWPEFARETFQ
AFRTTDVGRKLIIDQNVFIEGTLPMGVVRPLTEVEMDHYREPFLNPVDRE
PLWRFPNELPIAGEPANIVALVEEYMDWLHQSPVPKLLFWGTPGVLIPPA
EAARLAKSLPNCKAVDIGPGLNLLQEDNPDLIGSEIARWLSTLEISGGSS
GVFTLEDFVGDWKQTAAYNLDQVLEQGGVSSLLQNLAVSVTPIQRMVRSG
ENALKIDIHVIIPYEGLSADQMAQIEEVFKVVYPVDDHHFKVILHYGTLV
IDGVTPNMLNYFGRPYEGIAVFDGKKITVTGTLWNGAKIIDERLITPDGS
MSFQVTINSSGLRSRGEPQQSFSEAQQQLCNTRQEVNELRKLLEEERDQR
VAAENALSVAEEQIRRLEHSEWDSSRTPIIGSCGTQEQALLIDLTSNSCR
RTRSGVGWKRVLRSLCHSRTRVPLLAAIYFLMIHVLLILCFTGHL LgBiT*-Lysosome Sensor Amino Acid
(SEQ ID NO: 986)
MAAPGSARRPLLLLLLLLLLGLMHCASAAMFMVKNGNGTACIMANFSAA
FSVNYDTKSGPKNMTFDLPSDATVVLNRSSCGKENTSDPSLVIAFGRGH
TLTLNFTRNATRYSVQLMSFVYNLSDTHLFPNASSKEIKTVESITDIRA
DIDKKYRCVSGTQVHMNNVTVTLHDATIQAYLSNSSFSRGETRCEQDRP
SPTTAPPAPPSPSPSPVPKSPSVDKYNVSGTNGTCLLASMGLQLNLTYE
RKDNTTVTRLLNINPNKTSASGSCGAHLVTLELHSEGTTVLLFQFGMNA
SSSRFFLQGIQLNTILPDARDPAFKAANGSLRALQATVGNSYKCNAEEH
VRVTKAFSVNIFKVWVQAFKVEGGQFGSVEECLLDENSMLIPIAVGGAL
AGLVLIVLIAYLVGRKRSHAGYQTIKDPPVATMAEIGTGFPFDPHYVEV
LGERMHYVDVGPRDGTPVLFLHGNPTSSYVWRNIIPHVAPTHRCIAPDL
IGMGKSDKPDLGYFFDDHVRFMDAFIEALGLEEVVLVIHDWGSALGFHW
AKRNPERVKGIAFMEFIRPIPTWDEWPEFARETFQAFRTTDVGRKLIID
QNVFIEGTLPMGVVRPLTEVEMDHYREPFLNPVDREPLWRFPNELPIAG
EPANIVALVEEYMDWLHQSPVPKLLFWGTPGVLIPPAEAARLAKSLPNC
KAVDIGPGLNLLQEDNPDLIGSEIARWLSTLEISGGSSGVFTLEDFVGD
WKQTAAYNLDQVLEQGGVSSLLQNLAVSVTPIQRMVRSGENALKIDIHV
IIPYEGLSADQMAQIEEVFKVVYPVDDHHFKVILHYGTLVIDGVTPNML
NYFGRPYEGIAVFDGKKITVTGTLWNGAKIIDERLITPDGSMSFQVTIN
S

SEQUENCE LISTING (986 sequences)

SEQ ID NO: 1 - protein, 170 aa, Oplophorus gracilirostris
MFTLADFVGDWQQTAGYNQDQVLEQGGLSSLFQALGVSVTPIQKVVLSGENGLKADIHVIIPYEGLSGFQMGLIEMIFKVVYPVDDHHFKIILHYGTLVIDGVTPNMIDYFGRPYPGIAVFDGKQITVTGTLWNGNKIYDERLINPDGSLLFRVTINGVTGWRLCENILA

SEQ ID NO: 2 - DNA, 513 bp, Oplophorus gracilirostris
atggtgtttaccttggcagatttcgttggagactggcaacagacagctggatacaaccaagatcaagtgttagaacaaggaggattgtctagtctgttccaagccctgggagtgtcagtcaccccaatccagaaagttgtgctgtctggggagaatgggttaaaagctgatattcatgtcatcatcccttacgagggactcagtggttttcaaatgggtctgattgaaatgatcttcaaagttgtttacccagtggatgatcatcatttcaagattattctccattatggtacactcgttattgacggtgtgacaccaaacatgattgactactttggacgcccttaccctggaattgctgtgtttgacggcaagcagatcacagttactggaactctgtggaacggcaacaagatctatgatgagcgcctgatcaacccagatggttcactcctcttccgcgttactatcaatggagtcaccggatggcgcctttgcgagaacattcttgcc

SEQ ID NO: 3 - protein, 183 aa, Artificial sequence
  Synthetic
MKHHHHHHAIAMVFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTINGVTGWRLCERILAV

SEQ ID NO: 4 - DNA, 549 bp, Artificial sequence
  Synthetic
atgaaacatcaccatcaccatcatgcgatcgccatggtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacggagtgaccggctggcggctgtgcgaacgcattctggcggtt

SEQ ID NO: 5 - protein, 147 aa, Oplophorus gracilirostris
MFTLADFVGDWQQTAGYNQDQVLEQGGLSSLFQALGVSVTPIQKVVLSGENGLKADIHVIIPYEGLSGFQMGLIEMIFKVVYPVDDHHFKIILHYGTLVIDGVTPNMIDYFGRPYPGIAVFDGKQITVTGTLWNGNKIYDERLINPD

SEQ ID NO: 6 - protein, 10 aa, Oplophorus gracilirostris
GSLLFRVTIN

SEQ ID NO: 7 - protein, 13 aa, Oplophorus gracilirostris
GVTGWRLCENILA

SEQ ID NO: 8 - protein, 148 aa, Oplophorus gracilirostris
MVFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPD

SEQ ID NO: 9 - protein, 11 aa, Oplophorus gracilirostris
GSLLFRVTINV

SEQ ID NO: 10 - protein, 13 aa, Oplophorus gracilirostris
GVTGWRLCERILA

SEQ ID NO: 11 - protein, 165 aa, Artificial sequence
  Synthetic
MVFTLEDFVGDWEQTAAYNLDQVLEQGGVSSLLQNLAVSVTPIQRIVRSGENALKIDIHVIIPYEGLSADQMAQIEEVFKVVYPVDDHHFKVILPYGTLVIDGVTPNMLNYFGRPYEGIAVFDGKKITVTGTLWNGNKIIDERLITPDGSMLFRVTINSHHHHHH

SEQ ID NO: 12 - DNA, 495 bp, Artificial sequence
  Synthetic
atggtcttcacactcgaagatttcgttggggactgggaacagacagccgcctacaacctggaccaagtccttgaacagggaggtgtgtccagtttgctgcagaatctcgccgtgtccgtaactccgatccaaaggattgtccggagcggtgaaaatgccctgaagatcgacatccatgtcatcatcccgtatgaaggtctgagcgccgaccaaatggcccagatcgaagaggtgtttaaggtggtgtaccctgtggatgatcatcactttaaggtgatcctgccctatggcacactggtaatcgacggggttacgccgaacatgctgaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacagccatcatcaccatcaccac

SEQ ID NO: 13 - protein, 11 aa, Artificial sequence
  Synthetic
VTGYRLFEEIL

SEQ ID NO: 14 - DNA, 33 bp, Artificial sequence
  Synthetic
gtgaccggctaccggctgttcgaggagattctg

SEQ ID NO: 15 - protein, 11 aa, Artificial sequence
  Synthetic
VSGWRLFKKIS

SEQ ID NO: 16 - DNA, 33 bp, Artificial sequence
  Synthetic
gtgagcggctggcggctgttcaagaagattagc

SEQ ID NO: 17 - protein, 148 aa, Artificial sequence
  Synthetic
MVFTLEDFVGDWEQTAAYNLDQVLEQGGVSSLLQNLAVSVTPIQRIVRSGENALKIDIHVIIPYEGLSADQMAQIEEVFKVVYPVDDHHFKVILPYGTLVIDGVTPNMLNYFGRPYEGIAVFDGKKITVTGTLWNGNKIIDERLITPD

SEQ ID NO: 18 - DNA, 444 bp, Artificial sequence
  Synthetic
atggtcttcacactcgaagatttcgttggggactgggaacagacagccgcctacaacctggaccaagtccttgaacagggaggtgtgtccagtttgctgcagaatctcgccgtgtccgtaactccgatccaaaggattgtccggagcggtgaaaatgccctgaagatcgacatccatgtcatcatcccgtatgaaggtctgagcgccgaccaaatggcccagatcgaagaggtgtttaaggtggtgtaccctgtggatgatcatcactttaaggtgatcctgccctatggcacactggtaatcgacggggttacgccgaacatgctgaactatttcggacggccgtatgaaggcatcgccgtgttcgacggcaaaaagatcactgtaacagggaccctgtggaacggcaacaaaattatcgacgagcgcctgatcacccccgac

SEQ ID NO: 19 - protein, 155 aa, Artificial sequence
  Synthetic
MKHHHHHHVFTLDDFVGDWEQTAAYNLDQVLEQGGVSSLLQNLAVSVTPIMRIVRSGENALKIDIHVIIPYEGLSADQMAQIEEVFKVVYPVDDHHFKVILPYGTLVIDGVTPNKLNYFGRPYEGIAVFDGKKITVTGTLWNGNKIIDERLITPD

SEQ ID NO: 20 - DNA, 465 bp, Artificial sequence
  Synthetic
atgaaacatcaccatcaccatcatgtcttcacactcgaagatttcgttggggactgggaacagacagccgcctacaacctggaccaagtccttgaacagggaggtgtgtccagtttgctgcagaatctcgccgtgtccgtaactccgatccaaaggattgtccggagcggtgaaaatgccctgaagatcgacatccatgtcatcatcccgtatgaaggtctgagcgccgaccaaatggcccagatcgaagaggtgtttaaggtggtgtaccctgtggatgatcatcactttaaggtgatcctgccctatggcacactggtaatcgacggggttacgccgaacatgctgaactatttcggacggccgtatgaaggcatcgccgtgttcgacggcaaaaagatcactgtaacagggaccctgtggaacggcaacaaaattatcgacgagcgcctgatcacccccgac

SEQ ID NO: 21 - protein, 148 aa, Artificial sequence
  Synthetic
MVFTLDDFVGDWEQTAAYNLDQVLEQGGVSSLLQNLAVSVTPIMRIVRSGENALKIDIHVIIPYEGLSADQMAQIEEVFKVVYPVDDHHFKVILPYGTLVIDGVTPNKLNYFGRPYEGIAVFDGKKITVTGTLWNGNKIIDERLITPD

SEQ ID NO: 22 - DNA, 444 bp, Artificial sequence
  Synthetic
atggtcttcacactcgacgatttcgttggggactgggaacagacagccgcctacaacctggaccaagtccttgaacagggaggtgtgtccagtttgctgcagaatctcgccgtgtccgtaactccgatcatgaggattgtccggagcggtgaaaatgccctgaagatcgacatccatgtcatcatcccgtatgaaggtctgagcgccgaccaaatggcccagatcgaagaggtgtttaaggtggtgtaccctgtggatgatcatcactttaaggtgatcctgccctatggcacactggtaatcgacggggttacgccgaacaagctgaactatttcggacggccgtatgaaggcatcgccgtgttcgacggcaaaaagatcactgtaacagggaccctgtggaacggcaacaaaattatcgacgagcgcctgatcacccccgac

SEQ ID NO: 23 - protein, 11 aa, Artificial sequence
  Synthetic
GSMLFRVTINS

SEQ ID NO: 24 - DNA, 33 bp, Artificial sequence
  Synthetic
ggctccatgctgttccgagtaaccatcaacagc

SEQ ID NO: 25 - protein, 11 aa, Artificial sequence
  Synthetic
VSGWRLFKKIS

SEQ ID NO: 26 - DNA, 33 bp, Artificial sequence; identical to SEQ ID NO: 16
  Synthetic

SEQ ID NO: 27 - protein, 148 aa, Artificial sequence
  Synthetic
MVFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPD

SEQ ID NO: 28 - DNA, 444 bp, Artificial sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgac

SEQ ID NO: 29 - protein, 11 aa, Artificial sequence
  Synthetic
GSMLFRVTINV

SEQ ID NO: 30 - DNA, 30 bp, Artificial sequence
  Synthetic
ggctccatgctgttccgagtaaccatcaac

SEQ ID NO: 31 - protein, 155 aa, Artificial sequence
  Synthetic
MKHHHHHHVFTLEDFVGDWEQTAAYNLDQVLEQGGVSSLLQNLAVSVTPIQRIVRSGENALKIDIHVIIPYEGLSADQMAQIEEVFKVVYPVDDHHFKVILPYGTLVIDGVTPNMLNYFGRPYEGIAVFDGKKITVTGTLWNGNKIIDERLITPD

SEQ ID NO: 32 - DNA, 465 bp, Artificial sequence; identical to SEQ ID NO: 20
  Synthetic

SEQ ID NO: 33 - DNA, 20 bp, Artificial sequence
  Synthetic
aagtcgagaaccatgaccac

SEQ ID NO: 34 - DNA, 20 bp, Artificial sequence
  Synthetic
cgccgcgtccgccgaagttg

SEQ ID NO: 35 - protein, 22 aa, Artificial sequence
  Synthetic
GSMLFRVTINSVSGWRLFKKIS

SEQ ID NO: 36 - DNA, 66 bp, Artificial sequence
  Synthetic
ggctccatgctgttccgagtaaccatcaacagcgtgagcggctggcggctgttcaagaagattagc

SEQ ID NO: 37 - protein, 16 aa, Artificial sequence
  Synthetic
SSWKRGSMLFRVTINS

SEQ ID NO: 38 - DNA, 48 bp, Artificial sequence
  Synthetic
agcagctggaagcgcggctccatgctgttccgagtaaccatcaacagc

SEQ ID NO: 39 - protein, 155 aa, Artificial sequence
  Synthetic
MKHHHHHHVFTLDDFVGDWEQTAAYNLDQVLEQGGVSSLLQNLAVSVTPIMRIVRSGENALKIDIHVIIPYEGLSADQMAQIEEVFKVVYPVDDHHFKVILPYGTLVIDGDTPNKLNYFGRPYDGIAVFDGKKITVTGTLWNGNKIIDERLITPD

SEQ ID NO: 40 - DNA, 465 bp, Artificial sequence
  Synthetic
atgaaacatcaccatcaccatcatgtcttcacactcgacgatttcgttggggactgggaacagacagccgcctacaacctggaccaagtccttgaacagggaggtgtgtccagtttgctgcagaatctcgccgtgtccgtaactccgatcatgaggattgtccggagcggtgaaaatgccctgaagatcgacatccatgtcatcatcccgtatgaaggtctgagcgccgaccaaatggcccagatcgaagaggtgtttaaggtggtgtaccctgtggatgatcatcactttaaggtgatcctgccctatggcacactggtaatcgacggggatacgccgaacaagctgaactatttcggacggccgtatgatggcatcgccgtgttcgacggcaaaaagatcactgtaacagggaccctgtggaacggcaacaaaattatcgacgagcgcctgatcacccccgac

SEQ ID NO: 41 - protein, 155 aa, Artificial sequence
  Synthetic
MKHHHHHHVFTLDDFVGDWEQTAAYNLDQVLEQGGVSSLLQNLAVSVTPIMRIVRSGENALKIDIHVIIPYEGLSADQMAQIEEVFKVVYPVDDHHFKVILPYGTLVIDGVTPSKLNYFGRPYEGIAVFDGKKITVTGTLWNGNKIIDERLITPD

SEQ ID NO: 42 - DNA, 465 bp, Artificial sequence
  Synthetic
atgaaacatcaccatcaccatcatgtcttcacactcgacgatttcgttggggactgggaacagacagccgcctacaacctggaccaagtccttgaacagggaggtgtgtccagtttgctgcagaatctcgccgtgtccgtaactccgatcatgaggattgtccggagcggtgaaaatgccctgaagatcgacatccatgtcatcatcccgtatgaaggtctgagcgccgaccaaatggcccagatcgaagaggtgtttaaggtggtgtaccctgtggatgatcatcactttaaggtgatcctgccctatggcacactggtaatcgacggggttacgccgagcaagctgaactatttcggacggccgtatgaaggcatcgccgtgttcgacggcaaaaagatcactgtaacagggaccctgtggaacggcaacaaaattatcgacgagcgcctgatcacccccgac

SEQ ID NO: 43 - protein, 155 aa, Artificial sequence
  Synthetic
MKHHHHHHVFTLDDFVGDWEQTAAYNLDQVLEQGGVSSLLQNLAVSVTPIMRIVRSGENALKIDIHVIIPYEGLSADQMAQIEEVFKVVYPVDDHHFKVILPYGTLVIDGVTPNKLNYFGRPYEGFAVFDGKKITVTGTLWNGNKIIDERLITPD

SEQ ID NO: 44 - DNA, 465 bp, Artificial sequence
  Synthetic
atgaaacatcaccatcaccatcatgtcttcacactcgacgatttcgttggggactgggaacagacagccgcctacaacctggaccaagtccttgaacagggaggtgtgtccagtttgctgcagaatctcgccgtgtccgtaactccgatcatgaggattgtccggagcggtgaaaatgccctgaagatcgacatccatgtcatcatcccgtatgaaggtctgagcgccgaccaaatggcccagatcgaagaggtgtttaaggtggtgtaccctgtggatgatcatcactttaaggtgatcctgccctatggcacactggtaatcgacggggttacgccgaacaagctgaactatttcggacggccgtatgaaggcttcgccgtgttcgacggcaaaaagatcactgtaacagggaccctgtggaacggcaacaaaattatcgacgagcgcctgatcacccccgac

SEQ ID NO: 45 - protein, 155 aa, Artificial sequence
  Synthetic
MKHHHHHHVFTLDDFVGDWEQTAAYNLDQVLEQGGVSSLLQNLAVSVTPIMRIVRSGENALKIDIHVIIPYEGLSADQMAQIEEVFKVVYPVDDHHFKVILPYGTLVIDGVTPNKLNYFGRPYEGIAVCDGKKITVTGTLWNGNKIIDERLITPD

SEQ ID NO: 46 - DNA, 465 bp, Artificial sequence
  Synthetic
atgaaacatcaccatcaccatcatgtcttcacactcgacgatttcgttggggactgggaacagacagccgcctacaacctggaccaagtccttgaacagggaggtgtgtccagtttgctgcagaatctcgccgtgtccgtaactccgatcatgaggattgtccggagcggtgaaaatgccctgaagatcgacatccatgtcatcatcccgtatgaaggtctgagcgccgaccaaatggcccagatcgaagaggtgtttaaggtggtgtaccctgtggatgatcatcactttaaggtgatcctgccctatggcacactggtaatcgacggggttacgccgaacaagctgaactatttcggacggccgtatgaaggcatcgccgtgtgcgacggcaaaaagatcactgtaacagggaccctgtggaacggcaacaaaattatcgacgagcgcctgatcacccccgac

SEQ ID NO: 47 - protein, 155 aa, Artificial sequence
  Synthetic
MKHHHHHHVFTLDDFVGDWEQTAAYNLDQVLEQGGVSSLLQNLAVSVTPIMRIVRSGENALKIDIHVIIPYEGLSADQMAQIEEVFKVVYPVDDHHFKVILPYGTLVIDGVTPNKLNYFGRPYEGIAVFDGKKISVTGTLWNGNKIIDERLITPD

SEQ ID NO: 48 - DNA, 465 bp, Artificial sequence
  Synthetic
atgaaacatcaccatcaccatcatgtcttcacactcgacgatttcgttggggactgggaacagacagccgcctacaacctggaccaagtccttgaacagggaggtgtgtccagtttgctgcagaatctcgccgtgtccgtaactccgatcatgaggattgtccggagcggtgaaaatgccctgaagatcgacatccatgtcatcatcccgtatgaaggtctgagcgccgaccaaatggcccagatcgaagaggtgtttaaggtggtgtaccctgtggatgatcatcactttaaggtgatcctgccctatggcacactggtaatcgacggggttacgccgaacaagctgaactatttcgggcggccgtatgaaggcatcgccgtgttcgacggcaaaaagatctctgtaacagggaccctgtggaacggcaacaaaattatcgacgagcgcctgatcacccccgac

SEQ ID NO: 49 - protein, 155 aa, Artificial sequence
  Synthetic
MKHHHHHHVFTLDDFVGDWEQTAAYNLDQVLEQGGVSSLLQNLAVSVTPIMRIVRSGENALKIDIHVIIPYEGLSADQMAQIEEVFKVVYPVDDHHFKVILPYGTLVIDGVTPNKLNYFGRPYEGIAVFDGKKITATGTLWNGNKIIDERLITPD

SEQ ID NO: 50 - DNA, 465 bp, Artificial sequence
  Synthetic
atgaaacatcaccatcaccatcatgtcttcacactcgacgatttcgttggggactgggaacagacagccgcctacaacctggaccaagtccttgaacagggaggtgtgtccagtttgctgcagaatctcgccgtgtccgtaactccgatcatgaggattgtccggagcggtgaaaatgccctgaagatcgacatccatgtcatcatcccgtatgaaggtctgagcgccgaccaaatggcccagatcgaagaggtgtttaaggtggtgtaccctgtggatgatcatcactttaaggtgatcctgccctatggcacactggtaatcgacggggttacgccgaacaagctgaactatttcggacggccgtatgaaggcatcgccgtgttcgacggcaaaaagatcactgcaacagggaccctgtggaacggcaacaaaattatcgacgagcgcctgatcacccccgac

SEQ ID NO: 51 - protein, 155 aa, Artificial sequence [sequence omitted]

SEQ ID NO: 52 - DNA, 465 bp, Artificial sequence
  Synthetic
atgaaacatcaccatcaccatcatgtcttcacactcgacgatttcgttggggactgggaacagacagccgcctacaacctggaccaagtccttgaacagggaggtgtgtccagtttgctgcagaatctcgccgtgtccgtaactccgatcatgaggattgtccggagcggtgaaaatgccctgaagatcgacatccatgtcatcatcccgtatgaaggtctgagcgccgaccaaatggcccagatcgaagaggtgtttaaggtggtgtaccctgtggatgatcatcactttaaggtgatcctgccctatggcacactggtaatcgacggggttacgccgaacaagctgaactatttcggacggccgtatgaaggcatcgccgtgttcgacggcaaaaagatcactaccacagggaccctgtggaacggcaacaaaattatcgacgagcgcctgatcacccccgac

SEQ ID NO: 53 - protein, 149 aa, Artificial sequence
  Synthetic
MVFTLDDFVGDWEQTAAYNLDQVLEQGGVSSLLQNLAVSVTPIMRIVRSGENALKIDIHVIIPYEGLSADQMAQIEEVFKVVYPVDDHHFKVILPYGTLVIDGVTPNKLNYFGRPYEGIAVFDGKKITTTGTLWNGNKIIDERLITPDG

SEQ ID NO: 54 - DNA, 447 bp, Artificial sequence
  Synthetic
atggtcttcacactcgacgatttcgttggggactgggaacagacagccgcctacaacctggaccaagtccttgaacagggaggtgtgtccagtttgctgcagaatctcgccgtgtccgtaactccgatcatgaggattgtccggagcggtgaaaatgccctgaagatcgacatccatgtcatcatcccgtatgaaggtctgagcgccgaccaaatggcccagatcgaagaggtgtttaaggtggtgtaccctgtggatgatcatcactttaaggtgatcctgccctatggcacactggtaatcgacggggttacgccgaacaagctgaactatttcggacggccgtatgaaggcatcgccgtgttcgacggcaaaaagatcactaccacagggaccctgtggaacggcaacaaaattatcgacgagcgcctgatcacccccgacggc

SEQ ID NO: 55 - protein, 147 aa, Artificial sequence
  Synthetic
MVFTLDDFVGDWEQTAAYNLDQVLEQGGVSSLLQNLAVSVTPIMRIVRSGENALKIDIHVIIPYEGLSADQMAQIEEVFKVVYPVDDHHFKVILPYGTLVIDGVTPNKLNYFGRPYEGIAVFDGKKITTTGTLWNGNKIIDERLITP

SEQ ID NO: 56 - DNA, 441 bp, Artificial sequence
  Synthetic
atggtcttcacactcgacgatttcgttggggactgggaacagacagccgcctacaacctggaccaagtccttgaacagggaggtgtgtccagtttgctgcagaatctcgccgtgtccgtaactccgatcatgaggattgtccggagcggtgaaaatgccctgaagatcgacatccatgtcatcatcccgtatgaaggtctgagcgccgaccaaatggcccagatcgaagaggtgtttaaggtggtgtaccctgtggatgatcatcactttaaggtgatcctgccctatggcacactggtaatcgacggggttacgccgaacaagctgaactatttcggacggccgtatgaaggcatcgccgtgttcgacggcaaaaagatcactaccacagggaccctgtggaacggcaacaaaattatcgacgagcgcctgatcaccccc

SEQ ID NO: 57 - protein, 146 aa, Artificial sequence
  Synthetic
MVFTLDDFVGDWEQTAAYNLDQVLEQGGVSSLLQNLAVSVTPIMRIVRSGENALKIDIHVIIPYEGLSADQMAQIEEVFKVVYPVDDHHFKVILPYGTLVIDGVTPNKLNYFGRPYEGIAVFDGKKITTTGTLWNGNKIIDERLIT

SEQ ID NO: 58 - DNA, 438 bp, Artificial sequence
  Synthetic
atggtcttcacactcgacgatttcgttggggactgggaacagacagccgcctacaacctggaccaagtccttgaacagggaggtgtgtccagtttgctgcagaatctcgccgtgtccgtaactccgatcatgaggattgtccggagcggtgaaaatgccctgaagatcgacatccatgtcatcatcccgtatgaaggtctgagcgccgaccaaatggcccagatcgaagaggtgtttaaggtggtgtaccctgtggatgatcatcactttaaggtgatcctgccctatggcacactggtaatcgacggggttacgccgaacaagctgaactatttcggacggccgtatgaaggcatcgccgtgttcgacggcaaaaagatcactaccacagggaccctgtggaacggcaacaaaattatcgacgagcgcctgatcacc

SEQ ID NO: 59 - protein, 150 aa, Artificial sequence
  Synthetic
MVFTLDDFVGDWEQTAAYNLDQVLEQGGVSSLLQNLAVSVTPIMRIVRSGENALKIDIHVIIPYEGLSADQMAQIEEVFKVVYPVDDHHFKVILPYGTLVIDGVTPNKLNYFGRPYEGIAVFDGKKITTTGTLWNGNKIIDERLITPDGS

SEQ ID NO: 60 - DNA, 450 bp, Artificial sequence
  Synthetic
atggtcttcacactcgacgatttcgttggggactgggaacagacagccgcctacaacctggaccaagtccttgaacagggaggtgtgtccagtttgctgcagaatctcgccgtgtccgtaactccgatcatgaggattgtccggagcggtgaaaatgccctgaagatcgacatccatgtcatcatcccgtatgaaggtctgagcgccgaccaaatggcccagatcgaagaggtgtttaaggtggtgtaccctgtggatgatcatcactttaaggtgatcctgccctatggcacactggtaatcgacggggttacgccgaacaagctgaactatttcggacggccgtatgaaggcatcgccgtgttcgacggcaaaaagatcactaccacagggaccctgtggaacggcaacaaaattatcgacgagcgcctgatcacccccgacggcagc

SEQ ID NO: 61 - protein, 164 aa, Artificial sequence
  Synthetic
MFTLEDFVGDWEQTAAYNLDQVLEQGGVSSLLQNLAVSVTPIQRIVRSGENALKIDIHVIIPYEGLSADQMAQIEEVFKVVYPVDDHHFKVILPYGTLVIDGVTPNMLNYFGRPYEGIAVFDGKKITVTGTLWNGNKIIDERLITPDGSMLFRVTINSHHHHHH

SEQ ID NO: 62 - DNA, 495 bp, Artificial sequence
  Synthetic
atgttcacactcgaagatttcgttggggactgggaacagacagccgcctacaacctggaccaagtccttgaacagggaggtgtgtccagtttgctgcagaatctcgccgtgtccgtaactccgatccaaaggattgtccggagcggtgaaaatgccctgaagatcgacatccatgtcatcatcccgtatgaaggtctgagcgccgaccaaatggcccagatcgaagaggtgtttaaggtggtgtaccctgtggatgatcatcactttaaggtgatcctgccctatggcacactggtaatcgacggggttacgccgaacatgctgaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacagccatcatcaccatcaccactaa

SEQ ID NO: 63 - protein, 163 aa, Artificial sequence
  Synthetic
MTLEDFVGDWEQTAAYNLDQVLEQGGVSSLLQNLAVSVTPIQRIVRSGENALKIDIHVIIPYEGLSADQMAQIEEVFKVVYPVDDHHFKVILPYGTLVIDGVTPNMLNYFGRPYEGIAVFDGKKITVTGTLWNGNKIIDERLITPDGSMLFRVTINSHHHHHH

SEQ ID NO: 64 - DNA, 492 bp, Artificial sequence
  Synthetic
atgacactcgaagatttcgttggggactgggaacagacagccgcctacaacctggaccaagtccttgaacagggaggtgtgtccagtttgctgcagaatctcgccgtgtccgtaactccgatccaaaggattgtccggagcggtgaaaatgccctgaagatcgacatccatgtcatcatcccgtatgaaggtctgagcgccgaccaaatggcccagatcgaagaggtgtttaaggtggtgtaccctgtggatgatcatcactttaaggtgatcctgccctatggcacactggtaatcgacggggttacgccgaacatgctgaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacagccatcatcaccatcaccactaa

SEQ ID NO: 65 - protein, 162 aa, Artificial sequence
  Synthetic
MLEDFVGDWEQTAAYNLDQVLEQGGVSSLLQNLAVSVTPIQRIVRSGENALKIDIHVIIPYEGLSADQMAQIEEVFKVVYPVDDHHFKVILPYGTLVIDGVTPNMLNYFGRPYEGIAVFDGKKITVTGTLWNGNKIIDERLITPDGSMLFRVTINSHHHHHH

SEQ ID NO: 66 - DNA, 489 bp, Artificial sequence
  Synthetic
atgctcgaagatttcgttggggactgggaacagacagccgcctacaacctggaccaagtccttgaacagggaggtgtgtccagtttgctgcagaatctcgccgtgtccgtaactccgatccaaaggattgtccggagcggtgaaaatgccctgaagatcgacatccatgtcatcatcccgtatgaaggtctgagcgccgaccaaatggcccagatcgaagaggtgtttaaggtggtgtaccctgtggatgatcatcactttaaggtgatcctgccctatggcacactggtaatcgacggggttacgccgaacatgctgaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacagccatcatcaccatcaccactaa

SEQ ID NO: 67 - protein, 161 aa, Artificial sequence
  Synthetic
MEDFVGDWEQTAAYNLDQVLEQGGVSSLLQNLAVSVTPIQRIVRSGENALKIDIHVIIPYEGLSADQMAQIEEVFKVVYPVDDHHFKVILPYGTLVIDGVTPNMLNYFGRPYEGIAVFDGKKITVTGTLWNGNKIIDERLITPDGSMLFRVTINSHHHHHH

SEQ ID NO: 68 - DNA, 486 bp, Artificial sequence
  Synthetic
atggaagatttcgttggggactgggaacagacagccgcctacaacctggaccaagtccttgaacagggaggtgtgtccagtttgctgcagaatctcgccgtgtccgtaactccgatccaaaggattgtccggagcggtgaaaatgccctgaagatcgacatccatgtcatcatcccgtatgaaggtctgagcgccgaccaaatggcccagatcgaagaggtgtttaaggtggtgtaccctgtggatgatcatcactttaaggtgatcctgccctatggcacactggtaatcgacggggttacgccgaacatgctgaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacagccatcatcaccatcaccactaa

SEQ ID NO: 69 - protein, 174 aa, Artificial sequence
  Synthetic
MFKKISGSSGVFTLEDFVGDWEQTAAYNLDQVLEQGGVSSLLQNLAVSVTPIQRIVRSGENALKIDIHVIIPYEGLSADQMAQIEEVFKVVYPVDDHHFKVILPYGTLVIDGVTPNMLNYFGRPYEGIAVFDGKKITVTGTLWNGNKIIDERLITPDGSMLFRVTINSHHHHHH

SEQ ID NO: 70 - DNA, 525 bp, Artificial sequence
  Synthetic
atgttcaagaagattagcggctcgagcggtgtcttcacactcgaagatttcgttggggactgggaacagacagccgcctacaacctggaccaagtccttgaacagggaggtgtgtccagtttgctgcagaatctcgccgtgtccgtaactccgatccaaaggattgtccggagcggtgaaaatgccctgaagatcgacatccatgtcatcatcccgtatgaaggtctgagcgccgaccaaatggcccagatcgaagaggtgtttaaggtggtgtaccctgtggatgatcatcactttaaggtgatcctgccctatggcacactggtaatcgacggggttacgccgaacatgctgaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacagccatcatcaccatcaccactaa

SEQ ID NO: 71 - protein, 173 aa, Artificial sequence
  Synthetic
MKKISGSSGVFTLEDFVGDWEQTAAYNLDQVLEQGGVSSLLQNLAVSVTPIQRIVRSGENALKIDIHVIIPYEGLSADQMAQIEEVFKVVYPVDDHHFKVILPYGTLVIDGVTPNMLNYFGRPYEGIAVFDGKKITVTGTLWNGNKIIDERLITPDGSMLFRVTINSHHHHHH

SEQ ID NO: 72 - DNA, 522 bp, Artificial sequence
  Synthetic
atgaagaagattagcggctcgagcggtgtcttcacactcgaagatttcgttggggactgggaacagacagccgcctacaacctggaccaagtccttgaacagggaggtgtgtccagtttgctgcagaatctcgccgtgtccgtaactccgatccaaaggattgtccggagcggtgaaaatgccctgaagatcgacatccatgtcatcatcccgtatgaaggtctgagcgccgaccaaatggcccagatcgaagaggtgtttaaggtggtgtaccctgtggatgatcatcactttaaggtgatcctgccctatggcacactggtaatcgacggggttacgccgaacatgctgaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacagccatcatcaccatcaccactaa

SEQ ID NO: 73 - protein, 172 aa, Artificial sequence
  Synthetic
MKISGSSGVFTLEDFVGDWEQTAAYNLDQVLEQGGVSSLLQNLAVSVTPIQRIVRSGENALKIDIHVIIPYEGLSADQMAQIEEVFKVVYPVDDHHFKVILPYGTLVIDGVTPNMLNYFGRPYEGIAVFDGKKITVTGTLWNGNKIIDERLITPDGSMLFRVTINSHHHHHH

SEQ ID NO: 74 - DNA, 519 bp, Artificial sequence
  Synthetic
atgaagattagcggctcgagcggtgtcttcacactcgaagatttcgttggggactgggaacagacagccgcctacaacctggaccaagtccttgaacagggaggtgtgtccagtttgctgcagaatctcgccgtgtccgtaactccgatccaaaggattgtccggagcggtgaaaatgccctgaagatcgacatccatgtcatcatcccgtatgaaggtctgagcgccgaccaaatggcccagatcgaagaggtgtttaaggtggtgtaccctgtggatgatcatcactttaaggtgatcctgccctatggcacactggtaatcgacggggttacgccgaacatgctgaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacagccatcatcaccatcaccactaa

SEQ ID NO: 75 - protein, 171 aa, Artificial sequence
  Synthetic
MISGSSGVFTLEDFVGDWEQTAAYNLDQVLEQGGVSSLLQNLAVSVTPIQRIVRSGENALKIDIHVIIPYEGLSADQMAQIEEVFKVVYPVDDHHFKVILPYGTLVIDGVTPNMLNYFGRPYEGIAVFDGKKITVTGTLWNGNKIIDERLITPDGSMLFRVTINSHHHHHH

SEQ ID NO: 76 - DNA, 516 bp, Artificial sequence
  Synthetic
atgattagcggctcgagcggtgtcttcacactcgaagatttcgttggggactgggaacagacagccgcctacaacctggaccaagtccttgaacagggaggtgtgtccagtttgctgcagaatctcgccgtgtccgtaactccgatccaaaggattgtccggagcggtgaaaatgccctgaagatcgacatccatgtcatcatcccgtatgaaggtctgagcgccgaccaaatggcccagatcgaagaggtgtttaaggtggtgtaccctgtggatgatcatcactttaaggtgatcctgccctatggcacactggtaatcgacggggttacgccgaacatgctgaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacagccatcatcaccatcaccactaa

SEQ ID NO: 77 - protein, 170 aa, Artificial sequence
  Synthetic
MSGSSGVFTLEDFVGDWEQTAAYNLDQVLEQGGVSSLLQNLAVSVTPIQRIVRSGENALKIDIHVIIPYEGLSADQMAQIEEVFKVVYPVDDHHFKVILPYGTLVIDGVTPNMLNYFGRPYEGIAVFDGKKITVTGTLWNGNKIIDERLITPDGSMLFRVTINSHHHHHH

SEQ ID NO: 78 - DNA, 513 bp, Artificial sequence
  Synthetic
atgagcggctcgagcggtgtcttcacactcgaagatttcgttggggactgggaacagacagccgcctacaacctggaccaagtccttgaacagggaggtgtgtccagtttgctgcagaatctcgccgtgtccgtaactccgatccaaaggattgtccggagcggtgaaaatgccctgaagatcgacatccatgtcatcatcccgtatgaaggtctgagcgccgaccaaatggcccagatcgaagaggtgtttaaggtggtgtaccctgtggatgatcatcactttaaggtgatcctgccctatggcacactggtaatcgacggggttacgccgaacatgctgaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacagccatcatcaccatcaccactaa

SEQ ID NO: 79 - protein, 158 aa, Artificial sequence
  Synthetic
MKHHHHHHVFTLDDFVGDWEQTAAYNLDQVLEQGGVSSLLQNLAVSVTPIMRIVRSGENALKIDIHVIIPYEGLSADQMAQIEEVFKVVYPVDDHHFKVILPYGTLVIDGVTPNKLNYFGRPYEGIAVFDGKKITTTGTLWNGNKIIDERLITPDGSM

SEQ ID NO: 80 - DNA, 477 bp, Artificial sequence
  Synthetic
atgaaacatcaccatcaccatcatgtcttcacactcgacgatttcgttggggactgggaacagacagccgcctacaacctggaccaagtccttgaacagggaggtgtgtccagtttgctgcagaatctcgccgtgtccgtaactccgatcatgaggattgtccggagcggtgaaaatgccctgaagatcgacatccatgtcatcatcccgtatgaaggtctgagcgccgaccaaatggcccagatcgaagaggtgtttaaggtggtgtaccctgtggatgatcatcactttaaggtgatcctgccctatggcacactggtaatcgacggggttacgccgaacaagctgaactatttcggacggccgtatgaaggcatcgccgtgttcgacggcaaaaagatcactaccacagggaccctgtggaacggcaacaaaattatcgacgagcgcctgatcacccccgacggcagcatgtaa

SEQ ID NO: 81 - protein, 159 aa, Artificial sequence
  Synthetic
MKHHHHHHVFTLDDFVGDWEQTAAYNLDQVLEQGGVSSLLQNLAVSVTPIMRIVRSGENALKIDIHVIIPYEGLSADQMAQIEEVFKVVYPVDDHHFKVILPYGTLVIDGVTPNKLNYFGRPYEGIAVFDGKKITTTGTLWNGNKIIDERLITPDGSML

SEQ ID NO: 82 - DNA, 480 bp, Artificial sequence
  Synthetic
atgaaacatcaccatcaccatcatgtcttcacactcgacgatttcgttggggactgggaacagacagccgcctacaacctggaccaagtccttgaacagggaggtgtgtccagtttgctgcagaatctcgccgtgtccgtaactccgatcatgaggattgtccggagcggtgaaaatgccctgaagatcgacatccatgtcatcatcccgtatgaaggtctgagcgccgaccaaatggcccagatcgaagaggtgtttaaggtggtgtaccctgtggatgatcatcactttaaggtgatcctgccctatggcacactggtaatcgacggggttacgccgaacaagctgaactatttcggacggccgtatgaaggcatcgccgtgttcgacggcaaaaagatcactaccacagggaccctgtggaacggcaacaaaattatcgacgagcgcctgatcacccccgacggcagcatgctgtaa

SEQ ID NO: 83 - protein, 160 aa, Artificial sequence
  Synthetic
MKHHHHHHVFTLDDFVGDWEQTAAYNLDQVLEQGGVSSLLQNLAVSVTPIMRIVRSGENALKIDIHVIIPYEGLSADQMAQIEEVFKVVYPVDDHHFKVILPYGTLVIDGVTPNKLNYFGRPYEGIAVFDGKKITTTGTLWNGNKIIDERLITPDGSMLF

SEQ ID NO: 84 - DNA, 483 bp, Artificial sequence
  Synthetic
atgaaacatcaccatcaccatcatgtcttcacactcgacgatttcgttggggactgggaacagacagccgcctacaacctggaccaagtccttgaacagggaggtgtgtccagtttgctgcagaatctcgccgtgtccgtaactccgatcatgaggattgtccggagcggtgaaaatgccctgaagatcgacatccatgtcatcatcccgtatgaaggtctgagcgccgaccaaatggcccagatcgaagaggtgtttaaggtggtgtaccctgtggatgatcatcactttaaggtgatcctgccctatggcacactggtaatcgacggggttacgccgaacaagctgaactatttcggacggccgtatgaaggcatcgccgtgttcgacggcaaaaagatcactaccacagggaccctgtggaacggcaacaaaattatcgacgagcgcctgatcacccccgacggcagcatgctgttctaa

SEQ ID NO: 85 - protein, 152 aa, Artificial sequence
  Synthetic
MKHHHHHHVFTLDDFVGDWEQTAAYNLDQVLEQGGVSSLLQNLAVSVTPIMRIVRSGENALKIDIHVIIPYEGLSADQMAQIEEVFKVVYPVDDHHFKVILPYGTLVIDGVTPNKLNYFGRPYEGIAVFDGKKITTTGTLWNGNKIIDERLI

SEQ ID NO: 86 - DNA, 459 bp, Artificial sequence
  Synthetic
atgaaacatcaccatcaccatcatgtcttcacactcgacgatttcgttggggactgggaacagacagccgcctacaacctggaccaagtccttgaacagggaggtgtgtccagtttgctgcagaatctcgccgtgtccgtaactccgatcatgaggattgtccggagcggtgaaaatgccctgaagatcgacatccatgtcatcatcccgtatgaaggtctgagcgccgaccaaatggcccagatcgaagaggtgtttaaggtggtgtaccctgtggatgatcatcactttaaggtgatcctgccctatggcacactggtaatcgacggggttacgccgaacaagctgaactatttcggacggccgtatgaaggcatcgccgtgttcgacggcaaaaagatcactaccacagggaccctgtggaacggcaacaaaattatcgacgagcgcctgatctaa

SEQ ID NO: 87 - protein, 151 aa, Artificial sequence
  Synthetic
MKHHHHHHVFTLDDFVGDWEQTAAYNLDQVLEQGGVSSLLQNLAVSVTPIMRIVRSGENALKIDIHVIIPYEGLSADQMAQIEEVFKVVYPVDDHHFKVILPYGTLVIDGVTPNKLNYFGRPYEGIAVFDGKKITTTGTLWNGNKIIDERL

SEQ ID NO: 88 - DNA, 456 bp, Artificial sequence
  Synthetic
atgaaacatcaccatcaccatcatgtcttcacactcgacgatttcgttggggactgggaacagacagccgcctacaacctggaccaagtccttgaacagggaggtgtgtccagtttgctgcagaatctcgccgtgtccgtaactccgatcatgaggattgtccggagcggtgaaaatgccctgaagatcgacatccatgtcatcatcccgtatgaaggtctgagcgccgaccaaatggcccagatcgaagaggtgtttaaggtggtgtaccctgtggatgatcatcactttaaggtgatcctgccctatggcacactggtaatcgacggggttacgccgaacaagctgaactatttcggacggccgtatgaaggcatcgccgtgttcgacggcaaaaagatcactaccacagggaccctgtggaacggcaacaaaattatcgacgagcgcctgtaa

SEQ ID NO: 89 - protein, 150 aa, Artificial sequence
  Synthetic
MKHHHHHHVFTLDDFVGDWEQTAAYNLDQVLEQGGVSSLLQNLAVSVTPIMRIVRSGENALKIDIHVIIPYEGLSADQMAQIEEVFKVVYPVDDHHFKVILPYGTLVIDGVTPNKLNYFGRPYEGIAVFDGKKITTTGTLWNGNKIIDER

SEQ ID NO: 90 - DNA, 453 bp, Artificial sequence
  Synthetic
atgaaacatcaccatcaccatcatgtcttcacactcgacgatttcgttggggactgggaacagacagccgcctacaacctggaccaagtccttgaacagggaggtgtgtccagtttgctgcagaatctcgccgtgtccgtaactccgatcatgaggattgtccggagcggtgaaaatgccctgaagatcgacatccatgtcatcatcccgtatgaaggtctgagcgccgaccaaatggcccagatcgaagaggtgtttaaggtggtgtaccctgtggatgatcatcactttaaggtgatcctgccctatggcacactggtaatcgacggggttacgccgaacaagctgaactatttcggacggccgtatgaaggcatcgccgtgttcgacggcaaaaagatcactaccacagggaccctgtggaacggcaacaaaattatcgacgagcgctaa

SEQ ID NO: 91 - protein, 123 aa, Artificial sequence
  Synthetic
MVAILWHEMWHEGLEEASRLYFGERNVKGMFEVLEPLHAMMERGPQTLKETSFNQAYGRDLMEAQEWCRKYMKSGNVKDLTQAWDLYYHVFRRISGGSGGGGSGGSSSGGAIVSGWRLFKKIS

SEQ ID NO: 92 - DNA, 372 bp, Artificial sequence
  Synthetic
atggtggccatcctctggcatgagatgtggcatgaaggcctggaagaggcatctcgtttgtactttggggaaaggaacgtgaaaggcatgtttgaggtgctggagcccttgcatgctatgatggaacggggcccccagactctgaaggaaacatcctttaatcaggcctatggtcgagatttaatggaggcccaagagtggtgcaggaagtacatgaaatcagggaatgtcaaggacctcacccaagcctgggacctctattatcatgtgttccgacgaatcagtggtggttcaggtggtggcgggagcggtggctcgagcagcggtggagcgatcgtgagcggctggcggctgttcaagaagattagctaa

SEQ ID NO: 93 - protein, 125 aa, Artificial sequence
  Synthetic
MVAILWHEMWHEGLEEASRLYFGERNVKGMFEVLEPLHAMMERGPQTLKETSFNQAYGRDLMEAQEWCRKYMKSGNVKDLTQAWDLYYHVFRRISGGSGGGGSGGSSSGGAIVSVSGWRLFKKIS

SEQ ID NO: 94 - DNA, 378 bp, Artificial sequence
  Synthetic
atggtggccatcctctggcatgagatgtggcatgaaggcctggaagaggcatctcgtttgtactttggggaaaggaacgtgaaaggcatgtttgaggtgctggagcccttgcatgctatgatggaacggggcccccagactctgaaggaaacatcctttaatcaggcctatggtcgagatttaatggaggcccaagagtggtgcaggaagtacatgaaatcagggaatgtcaaggacctcacccaagcctgggacctctattatcatgtgttccgacgaatcagtggtggttcaggtggtggcgggagcggtggctcgagcagcggtggagcgatcgttagcgttagcggctggcgcctgttcaagaagatcagctaa

SEQ ID NO: 95 - protein, 129 aa, Artificial sequence
  Synthetic
MVAILWHEMWHEGLEEASRLYFGERNVKGMFEVLEPLHAMMERGPQTLKETSFNQAYGRDLMEAQEWCRKYMKSGNVKDLTQAWDLYYHVFRRISGGSGGGGSGGSSSGGAIVSGWRLFKKISHHHHHH

SEQ ID NO: 96 - DNA, 390 bp, Artificial sequence
  Synthetic
atggtggccatcctctggcatgagatgtggcatgaaggcctggaagaggcatctcgtttgtactttggggaaaggaacgtgaaaggcatgtttgaggtgctggagcccttgcatgctatgatggaacggggcccccagactctgaaggaaacatcctttaatcaggcctatggtcgagatttaatggaggcccaagagtggtgcaggaagtacatgaaatcagggaatgtcaaggacctcacccaagcctgggacctctattatcatgtgttccgacgaatcagtggtggttcaggtggtggcgggagcggtggctcgagcagcggtggagcgatcgtgagcggctggcggctgttcaagaagattagccatcatcaccatcaccactaa

SEQ ID NO: 97 - protein, 131 aa, Artificial sequence
  Synthetic
MVAILWHEMWHEGLEEASRLYFGERNVKGMFEVLEPLHAMMERGPQTLKETSFNQAYGRDLMEAQEWCRKYMKSGNVKDLTQAWDLYYHVFRRISGGSGGGGSGGSSSGGAIVSVSGWRLFKKISHHHHHH

SEQ ID NO: 98 - DNA, 396 bp, Artificial sequence
  Synthetic
atggtggccatcctctggcatgagatgtggcatgaaggcctggaagaggcatctcgtttgtactttggggaaaggaacgtgaaaggcatgtttgaggtgctggagcccttgcatgctatgatggaacggggcccccagactctgaaggaaacatcctttaatcaggcctatggtcgagatttaatggaggcccaagagtggtgcaggaagtacatgaaatcagggaatgtcaaggacctcacccaagcctgggacctctattatcatgtgttccgacgaatcagtggtggttcaggtggtggcgggagcggtggctcgagcagcggtggagcgatcgttagcgtgagcggctggcggctgttcaagaagattagccatcatcaccatcaccactaa

SEQ ID NO: 99 - protein, 118 aa, Artificial sequence
  Synthetic
MKHHHHHHVAILWHEMWHEGLEEASRLYFGERNVKGMFEVLEPLHAMMERGPQTLKETSFNQAYGRDLMEAQEWCRKYMKSGNVKDLTQAWDLYYHVFRRISGGSGGVSGWRLFKKIS

SEQ ID NO: 100 - DNA, 357 bp, Artificial sequence
  Synthetic
atgaaacatcaccatcaccatcatgtggccatcctctggcatgagatgtggcatgaaggcctggaagaggcatctcgtttgtactttggggaaaggaacgtgaaaggcatgtttgaggtgctggagcccttgcatgctatgatggaacggggcccccagactctgaaggaaacatcctttaatcaggcctatggtcgagatttaatggaggcccaagagtggtgcaggaagtacatgaaatcagggaatgtcaaggacctcacccaagcctgggacctctattatcatgtgttccgacgaatcagtggtggttcaggtggtgtgagcggctggcggctgttcaagaagattagctaa

SEQ ID NO: 101 - protein, 123 aa, Artificial sequence
  Synthetic
MKHHHHHHVAILWHEMWHEGLEEASRLYFGERNVKGMFEVLEPLHAMMERGPQTLKETSFNQAYGRDLMEAQEWCRKYMKSGNVKDLTQAWDLYYHVFRRISGGSGGGGSGGVSGWRLFKKIS

SEQ ID NO: 102 - DNA, 372 bp, Artificial sequence
  Synthetic
atgaaacatcaccatcaccatcatgtggccatcctctggcatgagatgtggcatgaaggcctggaagaggcatctcgtttgtactttggggaaaggaacgtgaaaggcatgtttgaggtgctggagcccttgcatgctatgatggaacggggcccccagactctgaaggaaacatcctttaatcaggcctatggtcgagatttaatggaggcccaagagtggtgcaggaagtacatgaaatcagggaatgtcaaggacctcacccaagcctgggacctctattatcatgtgttccgacgaatcagtggtggttcaggtggtggcgggagcggtggcgtgagcggctggcggctgttcaagaagattagctaa

SEQ ID NO: 103 - protein, 128 aa, Artificial sequence
  Synthetic
MKHHHHHHVAILWHEMWHEGLEEASRLYFGERNVKGMFEVLEPLHAMMERGPQTLKETSFNQAYGRDLMEAQEWCRKYMKSGNVKDLTQAWDLYYHVFRRISGGSGGGGSGGSSSGGVSGWRLFKKIS

SEQ ID NO: 104 - DNA, 387 bp, Artificial sequence
  Synthetic
atgaaacatcaccatcaccatcatgtggccatcctctggcatgagatgtggcatgaaggcctggaagaggcatctcgtttgtactttggggaaaggaacgtgaaaggcatgtttgaggtgctggagcccttgcatgctatgatggaacggggcccccagactctgaaggaaacatcctttaatcaggcctatggtcgagatttaatggaggcccaagagtggtgcaggaagtacatgaaatcagggaatgtcaaggacctcacccaagcctgggacctctattatcatgtgttccgacgaatcagtggtggttcaggtggtggcgggagcggtggctcgagcagcggtggagtgagcggctggcggctgttcaagaagattagctaa

SEQ ID NO: 105 - protein, 120 aa, Artificial sequence
  Synthetic
MKHHHHHHVAILWHEMWHEGLEEASRLYFGERNVKGMFEVLEPLHAMMERGPQTLKETSFNQAYGRDLMEAQEWCRKYMKSGNVKDLTQAWDLYYHVFRRISGGSGGVSVSGWRLFKKIS

SEQ ID NO: 106 - DNA, 363 bp, Artificial sequence
  Synthetic
atgaaacatcaccatcaccatcatgtggccatcctctggcatgagatgtggcatgaaggcctggaagaggcatctcgtttgtactttggggaaaggaacgtgaaaggcatgtttgaggtgctggagcccttgcatgctatgatggaacggggcccccagactctgaaggaaacatcctttaatcaggcctatggtcgagatttaatggaggcccaagagtggtgcaggaagtacatgaaatcagggaatgtcaaggacctcacccaagcctgggacctctattatcatgtgttccgacgaatcagtggtggttcaggtggtgttagcgttagcggctggcgcctgttcaagaagatcagctaa

SEQ ID NO: 107 - protein, 125 aa, Artificial sequence
  Synthetic
MKHHHHHHVAILWHEMWHEGLEEASRLYFGERNVKGMFEVLEPLHAMMERGPQTLKETSFNQAYGRDLMEAQEWCRKYMKSGNVKDLTQAWDLYYHVFRRISGGSGGGGSGGVSVSGWRLFKKIS

SEQ ID NO: 108 - DNA, 378 bp, Artificial sequence
  Synthetic
atgaaacatcaccatcaccatcatgtggccatcctctggcatgagatgtggcatgaaggcctggaagaggcatctcgtttgtactttggggaaaggaacgtgaaaggcatgtttgaggtgctggagcccttgcatgctatgatggaacggggcccccagactctgaaggaaacatcctttaatcaggcctatggtcgagatttaatggaggcccaagagtggtgcaggaagtacatgaaatcagggaatgtcaaggacctcacccaagcctgggacctctattatcatgtgttccgacgaatcagtggtggttcaggtggtggcgggagcggtggcgttagcgttagcggctggcgcctgttcaagaagatcagctaa

SEQ ID NO: 109 - protein, 130 aa, Artificial sequence
  Synthetic
MKHHHHHHVAILWHEMWHEGLEEASRLYFGERNVKGMFEVLEPLHAMMERGPQTLKETSFNQAYGRDLMEAQEWCRKYMKSGNVKDLTQAWDLYYHVFRRISGGSGGGGSGGSSSGGVSVSGWRLFKKIS

SEQ ID NO: 110 - DNA, 393 bp, Artificial sequence
  Synthetic
atgaaacatcaccatcaccatcatgtggccatcctctggcatgagatgtggcatgaaggcctggaagaggcatctcgtttgtactttggggaaaggaacgtgaaaggcatgtttgaggtgctggagcccttgcatgctatgatggaacggggcccccagactctgaaggaaacatcctttaatcaggcctatggtcgagatttaatggaggcccaagagtggtgcaggaagtacatgaaatcagggaatgtcaaggacctcacccaagcctgggacctctattatcatgtgttccgacgaatcagtggtggttcaggtggtggcgggagcggtggctcgagcagcggtggagttagcgttagcggctggcgcctgttcaagaagatcagctaa

SEQ ID NO: 111 - protein, 134 aa, Artificial sequence
  Synthetic
MGSMLFRVTINSSSSGGGGSGGGSSGGGVQVETISPGDGRTFPKRGQTCVVHYTGMLEDGKKFDSSRDRNKPFKFMLGKQEVIRGWEEGVAQMSVGQRAKLTISPDYAYGATGHPGIIPPHATLVFDVELLKLE

SEQ ID NO: 112 - DNA, 405 bp, Artificial sequence
  Synthetic
atgggctccatgctgttccgagtaaccatcaacagctcgagttcaggtggtggcgggagcggtggagggagcagcggtggaggagtgcaggtggaaaccatctccccaggagacgggcgcaccttccccaagcgcggccagacctgcgtggtgcactacaccgggatgcttgaagatggaaagaaatttgattcctcccgggacagaaacaagccctttaagtttatgctaggcaagcaggaggtgatccgaggctgggaagaaggggttgcccagatgagtgtgggtcagagagccaaactgactatatctccagattatgcctatggtgccactgggcacccaggcatcatcccaccacatgccactctcgtcttcgatgtggagcttctaaaactggaataa

SEQ ID NO: 113 - protein, 136 aa, Artificial sequence
  Synthetic
MGVQVETISPGDGRTFPKRGQTCVVHYTGMLEDGKKFDSSRDRNKPFKFMLGKQEVIRGWEEGVAQMSVGQRAKLTISPDYAYGATGHPGIIPPHATLVFDVELLKLEGGSGGGGSGGSSSGGAIGSMLFRVTINS

SEQ ID NO: 114 - DNA, 408 bp, Artificial sequence
  Synthetic
atgggagtgcaggtggaaaccatctccccaggagacgggcgcaccttccccaagcgcggccagacctgcgtggtgcactacaccgggatgcttgaagatggaaagaaatttgattcctcccgggacagaaacaagccctttaagtttatgctaggcaagcaggaggtgatccgaggctgggaagaaggggttgcccagatgagtgtgggtcagagagccaaactgactatatctccagattatgcctatggtgccactgggcacccaggcatcatcccaccacatgccactctcgtcttcgatgtggagcttctaaaactggaaggtggttcaggtggtggcgggagcggtggctcgagcagcggtggagcgatcggctccatgctgttccgagtaaccatcaacagc

SEQ ID NO: 115 - protein, 165 aa, Artificial sequence; identical to SEQ ID NO: 11
  Synthetic

SEQ ID NO: 116 - DNA, 498 bp, Artificial sequence
  Synthetic
atggtcttcacactcgaagatttcgttggggactgggaacagacagccgcctacaacctggaccaagtccttgaacagggaggtgtgtccagtttgctgcagaatctcgccgtgtccgtaactccgatccaaaggattgtccggagcggtgaaaatgccctgaagatcgacatccatgtcatcatcccgtatgaaggtctgagcgccgaccaaatggcccagatcgaagaggtgtttaaggtggtgtaccctgtggatgatcatcactttaaggtgatcctgccctatggcacactggtaatcgacggggttacgccgaacatgctgaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacagccatcatcaccatcaccactaa

SEQ ID NO: 117 - protein, 158 aa, Artificial sequence
  Synthetic
VFTLEDFVGDWKQTAAYNLDQVLEQGGVSSLLQNLAVSVTPIQRMVRSGENALKIDIHVIIPYEGLSADQMAQIEEVFKVVYPVDDHHFKVILHYGTLVIDGVTPNMLNYFGRPYEGIAVFDGKKITVTGTLWNGVKIIDERLITPDGSMSFRVTINS

SEQ ID NO: 118 - DNA, 474 bp, Artificial sequence
  Synthetic
gtcttcacactcgaagatttcgttggggactggaaacagacagccgcctacaacctggaccaagtccttgaacagggaggtgtgtccagtttgctgcagaatctcgccgtgtccgtaactccgatccaaaggatggtccggagcggtgaaaatgccctgaagatcgacatccatgtcatcatcccgtatgaaggtctgagcgccgaccaaatggcccagatcgaagaggtgtttaaggtggtgtaccctgtggatgatcatcactttaaggtgatcctgccctatggcacactggtaatcgacggggttacgccgaacatgctgaactatttcggacggccgtatgaaggcatcgccgtgctcgacggcaaaaagatcactgtaacagggaccctgtggaacggcgtcaaaattatagacgagcgcctgatcacccccgacggctccatgtccttccgagtaaccatcaacagc

SEQ ID NO: 119 - protein, 158 aa, Artificial sequence
  Synthetic
VFTLEDFVGDWKQTAAYNLDQVLEQGGVSSLLQNLAVSVTPIQRMVRSGENALKIDIHVIIPYEGLSADQMAQIEEVFKVVYPVDDHHFKVILPYGTLVIDGVTPNMLNYFGRPYEGIAVLDGKKITVTGTLWNGVKIIDERLITPDGSMSFRVTINS

SEQ ID NO: 120 - DNA, 474 bp, Artificial sequence
  Synthetic
gtcttcacactcgaagatttcgttggggactggaaacagacagccgcctacaacctggaccaagtccttgaacagggaggtgtgtccagtttgctgcagaatctcgccgtgtccgtaactccgatccaaaggatggtccggagcggtgaaaatgccctgaagatcgacatccatgtcatcatcccgtatgaaggtctgagcgccgaccaaatggcccagatcgaagaggtgtttaaggtggtgtaccctgtggatgatcatcactttaaggtgatcctgccctatggcacactggtaatcgacggggttacgccgaacatgctgaactatttcggacggccgtatgaaggcatcgccgtgttcgacggcaaaaagatcactgtaacagggaccctgtggaacggcgtcaaaattatcgacgagcgcctgatcacccccgacggctccatgtccttccgagtaaccatcaaccgc

SEQ ID NO: 121 - protein, 158 aa, Artificial sequence
  Synthetic
VFTLEDFVGDWKQTAAYNLDQVLEQGGVSSLLQNLAVSVTPIQRMVRSGENALKIDIHVIIPYEGLSADQMAQIEEVFKVVYPVDDHHFKVILPYGTLVIDGVTPNMLNYFGRPYEGIAVFDGKKITVTGTLWNGVKIIDERLITPDGSMSFRVTINR

SEQ ID NO: 122 - DNA, 474 bp, Artificial sequence
  Synthetic
gtcttcacactcgaagatttcgttggggactggaaacagacagccgcctacaacctggaccaagtccttgaacagggaggtgtgtccagtttgctgcagaatctcgccgtgtccgtaactccgatccaaaggatggtccggagcggtgaaaatgccctgaagatcgacatccatgtcatcatcccgtatgaaggtctgagcgccgaccaaatggcccagatcgaagaggtgtttaaggtggtgtaccctgtggatgatcttcactttaaggtgatcctgccctatggcacactggtaatcgacggggttacgccgaacatgctgaactatttcggacggccgtatgaaggcatcgccgtgttcgacggcaaaaagatcactgtaacagggaccctgtggaacggcgtcaaaattatcgacgagcgcctgatcacccccgacggctccatgtccttccgagtaaccatcaacagc

SEQ ID NO: 123 - protein, 158 aa, Artificial sequence
  Synthetic
VFTLEDFVGDWKQTAAYNLDQVLEQGGVSSLLQNLAVSVTPIQRMVRSGENALKIDIHVIIPYEGLSADQMAQIEEVFKVVYPVDDLHFKVILPYGTLVIDGVTPNMLNYFGRPYEGIAVFDGKKITVTGTLWNGVKIIDERLITPDGSMSFRVTINS

SEQ ID NO: 124 - DNA, 474 bp, Artificial sequence
  Synthetic
gtcttcacactcgaagatttcgttggggactggaaacagacagccgcctacaacctggaccaagtccttgaacagggaggtgtgtccagtttgctgcagaatctcgccgtgtccgtaactccgatccaaaggatggtccggagcggtgaaaatgccctgaagatcgacatccatgtcatcatcccgtatgaaggtctgagcgccgaccaaatggcccagatcgaagaggtgtttaaggtggtgtaccctgtggatgatcatcactttaaggtgatcctgccctatggcacactggtaatcgacggggttacgccgaacatgctgaactatttcggacggccgtatgaaggcatcgccgtgttcgacggcaaaaagatcactgtaacagggaccctgtggaacggcgtcaaaattatcgacgagcgcctgatcacccccgacggctccgtgtccttccgagtaaccatcaacagc

SEQ ID NO: 125 - protein, 158 aa, Artificial sequence
  Synthetic
VFTLEDFVGDWKQTAAYNLDQVLEQGGVSSLLQNLAVSVTPIQRMVRSGENALKIDIHVIIPYEGLSADQMAQIEEVFKVVYPVDDHHFKVILPYGTLVIDGVTPNMLNYFGRPYEGIAVFDGKKITVTGTLWNGVKIIDERLITPDGSVSFRVTINS

SEQ ID NO: 126 - DNA, 474 bp, Artificial sequence
  Synthetic
gtcttcacactcgaagatttcgttggggactggaaacagacagccgcctacaacctggaccaagtccttgaacagggaggtgtgtccagtttgctgcagaatcttgccgtgtccgtaactccgatccaaaggatggtccggagcggtgaaaatgccctgaagatcgacatccatgtcgtcatcccgtatgaaggtctgagcgccgaccaaatggcccagatcgaagaggtgtttaaggtggtgtaccctgtggatgatcatcactttaaggtgatcctgccctatggcacactggtaatcgacggggttacgccgaacatgctgaactatttcggacggccgtatgaaggcatcgccgtgttcgacggcaaaaagatcactgtaacagggaccctgtggaacggcgtcaaaattatcgacgagcgcctgatcacccccgacggctccatgtccttccgagtaaccatcaacagc

SEQ ID NO: 127 - protein, 158 aa, Artificial sequence
  Synthetic
VFTLEDFVGDWKQTAAYNLDQVLEQGGVSSLLQNLAVSVTPIQRMVRSGENALKIDIHVVIPYEGLSADQMAQIEEVFKVVYPVDDHHFKVILPYGTLVIDGVTPNMLNYFGRPYEGIAVFDGKKITVTGTLWNGVKIIDERLITPDGSMSFRVTINS

SEQ ID NO: 128 - DNA, 474 bp, Artificial sequence
  Synthetic
gtcttcacactcgaagatttcgttggggactggaaacagacagccgcctacaacctggcccaagtccttgaacagggaggtgtgtccagtttgctgcagaatctcgccgtgtccgtaactccgatccaaaggatggtccggagcggtgaaaatgccctgaagatcgacatccatgtcatcatcccgtatgaaggtctgagcgccgaccaaatggcccagatcgaagaggtgtttaaggtggtgtaccctgtggatgatcatcactttaaggtgatcctgccctatggcacactggtaatcgacggggttacgccgaacatgctgaactatttcggacggccgtatgaaggcatcgccgtgttcgacggcaaaaagatcactgtaacagggaccctgtggaacggcgtcaaaattatcgacgagcgcctgatcacccccgacggctccatgtccttccgagtaaccatcaacagc

SEQ ID NO: 129 - protein, 158 aa, Artificial sequence
  Synthetic
VFTLEDFVGDWKQTAAYNLAQVLEQGGVSSLLQNLAVSVTPIQRMVRSGENALKIDIHVIIPYEGLSADQMAQIEEVFKVVYPVDDHHFKVILPYGTLVIDGVTPNMLNYFGRPYEGIAVFDGKKITVTGTLWNGVKIIDERLITPDGSMSFRVTINS

SEQ ID NO: 130 - DNA, 474 bp, Artificial sequence
  Synthetic
gtcttcacactcgaagatttcgttggggactggaaacagacagccgcctacaacctggaccaagtccttgaacagggaggtgtgtccagtttgctgcagaatctcgccgtgtccgtaactccgatccaaaggatggtccggagcggtgaaaatgccctgaagatcgacatccatgtcatcatcccgtatgaaggtctgagcgccgacctaatggcccagatcgaagaggtgtttaaggtggtgtaccctgtggatgatcatcactttaaggtgatcctgccctatggcacactggtaatcgacggggttacgccgaacatgctgaactatttcggacggccgtatgaaggcatcgccgtattcgacggcaaaaagatcactgtaacagggaccctgtggaacggcgtcaaaattatcgacgagcgcctgatctcccccgacggctccatgtccttccgagtaaccatcaacagc

SEQ ID NO: 131 - protein, 158 aa, Artificial sequence
  Synthetic
VFTLEDFVGDWKQTAAYNLDQVLEQGGVSSLLQNLAVSVTPIQRMVRSGENALKIDIHVIIPYEGLSADLMAQIEEVFKVVYPVDDHHFKVILPYGTLVIDGVTPNMLNYFGRPYEGIAVFDGKKITVTGTLWNGVKIIDERLISPDGSMSFRVTINS

SEQ ID NO: 132 - DNA, 474 bp, Artificial sequence
  Synthetic
gtcttcacactcgaagatttcgttggggactggtaccagacagccgcctacaacctggaccaagtccttgaacagggaggtgtgtccagtttgctgcagaatctcgccgtgtccgtaactccgatccaaaggatggtccggagcggtgaaaatgccctgaagatcgacatccatgtcatcatcccgtatgaaggtctgagcgccgaccaaatggcccagatcgaagaggtgtttaaggtggtgtaccctgtggatgatcatcactttaaggtgatcctgccctatggcacactggtaatcgacggggttacgccgaacatgctgaactatttcggacggccgtatgaaggcatcgccgtgttcgacggcaaaaagatcactgtaacagggaccctgtggaacggcgtcaaaattatcgacgagcgcctgatcacccccgacggctccatgtccttccgagtaaccatcaacagc

SEQ ID NO: 133 - protein, 13 aa, Artificial sequence
  Synthetic
NVSGWRLFKKISN

SEQ ID NO: 134 - protein, 13 aa, Artificial sequence
  Synthetic
NVTGYRLFKKISN

SEQ ID NO: 135 - protein, 12 aa, Artificial sequence
  Synthetic
VSGWRLFKKISN

SEQ ID NO: 136 - protein, 11 aa, Artificial sequence
  Synthetic
SGWRLFKKISN

SEQ ID NO: 137 - protein, 10 aa, Artificial sequence
  Synthetic
GWRLFKKISN

SEQ ID NO: 138 - protein, 11 aa, Artificial sequence
  Synthetic
VTGYRLFEKIS

SEQ ID NO: 139 - protein, 10 aa, Artificial sequence
  Synthetic
SGWRLFKKIS

SEQ ID NO: 140 - protein, 6 aa, Artificial sequence
  Synthetic
VSGWRL

SEQ ID NO: 141 - protein, 7 aa, Artificial sequence
  Synthetic
VSGWRLF

SEQ ID NO: 142 - protein, 8 aa, Artificial sequence
  Synthetic
VSGWRLFK

SEQ ID NO: 143 - protein, 9 aa, Artificial sequence
  Synthetic
VSGWRLFKK

SEQ ID NO: 144 - protein, 10 aa, Artificial sequence
  Synthetic
VSGWRLFKKI

SEQ ID NO: 145 - protein, 11 aa, Artificial sequence
  Synthetic
VSGWRLYKKIS

SEQ ID NO: 146 - protein, 22 aa, Artificial sequence
  Synthetic
GSMLFRVTINSVSGWALFKKIS

SEQ ID NO: 147 - protein, 22 aa, Artificial sequence
  Synthetic
GSMLFRVTINSVTGYRLFEEIL

SEQ ID NO: 148 - protein, 16 aa, Artificial sequence
  Synthetic
GSMLFRVTINSSSWKR

SEQ ID NO: 149 - protein, 14 aa, Artificial sequence
  Synthetic
VSGVSGWRLFKKIS

SEQ ID NO: 150 - protein, 13 aa, Artificial sequence
  Synthetic
VSVSGWRLFKKIS

SEQ ID NO: 151 - protein, 12 aa, Artificial sequence
  Synthetic
VVSGWRLFKKIS

SEQ ID NO: 152 - protein, 15 aa, Artificial sequence
  Synthetic
SSWKRSMLFRVTINS

SEQ ID NO: 153 - protein, 14 aa, Artificial sequence
  Synthetic
SSWKRMLFRVTINS

SEQ ID NO: 154 - protein, 17 aa, Artificial sequence
  Synthetic
SSWKRDGSMLFRVTINS

SEQ ID NO: 155 - protein, 18 aa, Artificial sequence
  Synthetic
SSWKRPDGSMLFRVTINS

SEQ ID NO: 156 - protein, 16 aa, Artificial sequence
  Synthetic
SSWKRSMLFRVTINSV

SEQ ID NO: 157 - protein, 15 aa, Artificial sequence
  Synthetic
SSWKRMLFRVTINSV

SEQ ID NO: 158 - protein, 18 aa, Artificial sequence
  Synthetic
SSWKRDGSMLFRVTINSV

SEQ ID NO: 159 - protein, 19 aa, Artificial sequence
  Synthetic
SSWKRPDGSMLFRVTINSV

SEQ ID NO: 160 - protein, 17 aa, Artificial sequence
  Synthetic
SSWKRSMLFRVTINSVS

SEQ ID NO: 161 - protein, 16 aa, Artificial sequence
  Synthetic
SSWKRMLFRVTINSVS

SEQ ID NO: 162 - protein, 19 aa, Artificial sequence
  Synthetic
SSWKRDGSMLFRVTINSVS

SEQ ID NO: 163 - protein, 20 aa, Artificial sequence
  Synthetic
SSWKRPDGSMLFRVTINSVS

SEQ ID NO: 164 - protein, 15 aa, Artificial sequence
  Synthetic
SSWKRGSMLFRVTIN

SEQ ID NO: 165 - protein, 14 aa, Artificial sequence
  Synthetic
SSWKRGSMLFRVTI

SEQ ID NO: 166 - protein, 14 aa, Artificial sequence
  Synthetic
SSWKRSMLFRVTIN

SEQ ID NO: 167 - protein, 13 aa, Artificial sequence
  Synthetic
SSWKRMLFRVTIN

SEQ ID NO: 168 - protein, 16 aa, Artificial sequence
  Synthetic
SSWKRDGSMLFRVTIN

SEQ ID NO: 169 - protein, 17 aa, Artificial sequence
  Synthetic
SSWKRPDGSMLFRVTIN

SEQ ID NO: 170 - protein, 13 aa, Artificial sequence
  Synthetic
SSWKRSMLFRVTI

SEQ ID NO: 171 - protein, 12 aa, Artificial sequence
  Synthetic
SSWKRMLFRVTI

SEQ ID NO: 172 - protein, 15 aa, Artificial sequence
  Synthetic
SSWKRDGSMLFRVTI

SEQ ID NO: 173 - protein, 16 aa, Artificial sequence
  Synthetic
SSWKRPDGSMLFRVTI

SEQ ID NO: 174 - protein, 15 aa, Artificial sequence
  Synthetic
VSGWRLFKKISVFTL

SEQ ID NO: 175 - protein, 14 aa, Artificial sequence
  Synthetic
VSGWRLFKKISVFT

SEQ ID NO: 176 - protein, 13 aa, Artificial sequence
  Synthetic
VSGWRLFKKISVF

SEQ ID NO: 177 - protein, 12 aa, Artificial sequence
  Synthetic
VSGWRLFKKISV

SEQ ID NO: 178 - protein, 11 aa, Artificial sequence
  Synthetic
VSGWRLCKKIS

SEQ ID NO: 179 - protein, 22 aa, Artificial sequence
  Synthetic
VSGWRLFKKISGSMLFRVTINS

SEQ ID NO: 180 - protein, 13 aa, Artificial sequence
  Synthetic
SSWKRLFRVTINS

SEQ ID NO: 181 - protein, 12 aa, Artificial sequence
  Synthetic
SSWKRFRVTINS

SEQ ID NO: 182 - protein, 11 aa, Artificial sequence
  Synthetic
SSWKRRVTINS

SEQ ID NO: 183 - protein, 19 aa, Artificial sequence
  Synthetic
SSWKRTPDGSMLFRVTINS

SEQ ID NO: 184 - protein, 20 aa, Artificial sequence
  Synthetic
SSWKRITPDGSMLFRVTINS

SEQ ID NO: 185 - protein, 21 aa, Artificial sequence
  Synthetic
SSWKRLITPDGSMLFRVTINS

SEQ ID NO: 186 - protein, 16 aa, Artificial sequence
  Synthetic
SSRGSMLFRVTINSWK

SEQ ID NO: 187 - protein, 16 aa, Artificial sequence
  Synthetic
SKRGSMLFRVTINSWS

SEQ ID NO: 188 - protein, 14 aa, Artificial sequence
  Synthetic
SWRGSMLFRVTINS

SEQ ID NO: 189 - protein, 14 aa, Artificial sequence
  Synthetic
SSRGSMLFRVTIWK

SEQ ID NO: 190 - protein, 16 aa, Artificial sequence
  Synthetic
SSWKRGSMLYRVTINS

SEQ ID NO: 191 - protein, 16 aa, Artificial sequence
  Synthetic
SSWKRGSMLWRVTINS

SEQ ID NO: 192 - protein, 16 aa, Artificial sequence
  Synthetic
SSWKRGSMLHRVTINS

SEQ ID NO: 193 - protein, 16 aa, Artificial sequence
  Synthetic
SSWKRGSLLFRVTINS

SEQ ID NO: 194 - protein, 16 aa, Artificial sequence
  Synthetic
SSWKRGSKLFRVTINS

SEQ ID NO: 195 - protein, 16 aa, Artificial sequence
  Synthetic
SSWKRGSRLFRVTINS

SEQ ID NO: 196 - protein, 16 aa, Artificial sequence
  Synthetic
SSWKRGSFLFRVTINS

SEQ ID NO: 197 - protein, 16 aa, Artificial sequence
  Synthetic
SSWKRGSWLFRVTINS

SEQ ID NO: 198 - protein, 16 aa, Artificial sequence
  Synthetic
SSWKRGSMLFRVSINS

SEQ ID NO: 199 - protein, 16 aa, Artificial sequence
  Synthetic
SSWKRGSMLFRVQINS

SEQ ID NO: 200 - protein, 16 aa, Artificial sequence
  Synthetic
SSWKRGSMLFRVNINS

SEQ ID NO: 201 - protein, 17 aa, Artificial sequence
  Synthetic
SSWKRGSMLFRVTINSC

SEQ ID NO: 202 - protein, 12 aa, Artificial sequence
  Synthetic
CVSGWRLFKKIS

SEQ ID NO: 203 - protein, 17 aa, Artificial sequence
  Synthetic
SSWKRGSMLFRVTINSK

SEQ ID NO: 204 - protein, 12 aa, Artificial sequence
  Synthetic
KVSGWRLFKKIS

SEQ ID NO: 205 - protein, 23 aa, Artificial sequence
  Synthetic
GSLLFRVTINGVTGWRLCENILA

SEQ ID NO: 206 - protein, 24 aa, Artificial sequence
  Synthetic
GSLLFRVTINVGVTGWRLCERILA

SEQ ID NO: 207 - protein, 12 aa, Artificial sequence
  Synthetic
SVSGWRLFKKIS

SEQ ID NO: 208 - protein, 13 aa, Artificial sequence
  Synthetic
NSVSGWRLFKKIS

SEQ ID NO: 209 - protein, 9 aa, Artificial sequence
  Synthetic
GWRLFKKIS

SEQ ID NO: 210 - DNA, 501 bp, Artificial sequence
  Synthetic
atggtgagcggctggcggctgttcaagaagattagccaccatcaccatcaccatcatcacttcacactcgacgatttcgttggggactgggaacagacagccgcctacaacctggaccaagtccttgaacagggaggtgtgtccagtttgctgcagaatctcgccgtgtccgtaactccgatcatgaggattgtccggagcggtgaaaatgccctgaagatcgacatccatgtcatcatcccgtatgaaggtctgagcgccgaccaaatggcccagatcgaagaggtgtttaaggtggtgtaccctgtggatgatcatcactttaaggtgatcctgccctatggcacactggtaatcgacggggttacgccgaacaagctgaactatttcggacggccgtatgaaggcatcgccgtgttcgacggcaaaaagatcactaccacagggaccctgtggaacggcaacaaaattatcgacgagcgcctgatcacccccgactaa

SEQ ID NO: 211 - protein, 166 aa, Artificial sequence
  Synthetic
MVSGWRLFKKISHHHHHHHHFTLDDFVGDWEQTAAYNLDQVLEQGGVSSLLQNLAVSVTPIMRIVRSGENALKIDIHVIIPYEGLSADQMAQIEEVFKVVYPVDDHHFKVILPYGTLVIDGVTPNKLNYFGRPYEGIAVFDGKKITTTGTLWNGNKIIDERLITPD

SEQ ID NO: 212 - DNA, 510 bp, Artificial sequence
  Synthetic
atgaaacatcaccatcaccatcatgtgagcggctggcggctgttcaagaagattagcggcagctccggtttcacactcgacgatttcgttggggactgggaacagacagccgcctacaacctggaccaagtccttgaacagggaggtgtgtccagtttgctgcagaatctcgccgtgtccgtaactccgatcatgaggattgtccggagcggtgaaaatgccctgaagatcgacatccatgtcatcatcccgtatgaaggtctgagcgccgaccaaatggcccagatcgaagaggtgtttaaggtggtgtaccctgtggatgatcatcactttaaggtgatcctgccctatggcacactggtaatcgacggggttacgccgaacaagctgaactatttcggacggccgtatgaaggcatcgccgtgttcgacggcaaaaagatcactaccacagggaccctgtggaacggcaacaaaattatcgacgagcgcctgatcacccccgactaa

SEQ ID NO: 213 - protein, 169 aa, Artificial sequence
  Synthetic
MKHHHHHHVSGWRLFKKISGSSGFTLDDFVGDWEQTAAYNLDQVLEQGGVSSLLQNLAVSVTPIMRIVRSGENALKIDIHVIIPYEGLSADQMAQIEEVFKVVYPVDDHHFKVILPYGTLVIDGVTPNKLNYFGRPYEGIAVFDGKKITTTGTLWNGNKIIDERLITPD

SEQ ID NO: 214 - DNA, 366 bp, Artificial sequence
  Synthetic
atggtggccatcctctggcatgagatgtggcatgaaggcctggaagaggcatctcgtttgtactttggggaaaggaacgtgaaaggcatgtttgaggtgctggagcccttgcatgctatgatggaacggggcccccagactctgaaggaaacatcctttaatcaggcctatggtcgagatttaatggaggcccaagagtggtgcaggaagtacatgaaatcagggaatgtcaaggacctcacccaagcctgggacctctattatcatgtgttccgacgaatcagtggtggttcaggtggtggcgggagcggtggctcgagcagcggtggagtgagcggctggcggctgttcaagaagattagctaa

SEQ ID NO: 215 - protein, 121 aa, Artificial sequence
  Synthetic
MVAILWHEMWHEGLEEASRLYFGERNVKGMFEVLEPLHAMMERGPQTLKETSFNQAYGRDLMEAQEWCRKYMKSGNVKDLTQAWDLYYHVFRRISGGSGGGGSGGSSSGGVSGWRLFKKIS

SEQ ID NO: 216 - DNA, 372 bp, Artificial sequence
  Synthetic
atggtggccatcctctggcatgagatgtggcatgaaggcctggaagaggcatctcgtttgtactttggggaaaggaacgtgaaaggcatgtttgaggtgctggagcccttgcatgctatgatggaacggggcccccagactctgaaggaaacatcctttaatcaggcctatggtcgagatttaatggaggcccaagagtggtgcaggaagtacatgaaatcagggaatgtcaaggacctcacccaagcctgggacctctattatcatgtgttccgacgaatcagtggtggttcaggtggtggcgggagcggtggctcgagcagcggtggagttagcgttagcggctggcgcctgttcaagaagatcagctaa

SEQ ID NO: 217 - protein, 123 aa, Artificial sequence
  Synthetic
MVAILWHEMWHEGLEEASRLYFGERNVKGMFEVLEPLHAMMERGPQTLKETSFNQAYGRDLMEAQEWCRKYMKSGNVKDLTQAWDLYYHVFRRISGGSGGGGSGGSSSGGVSVSGWRLFKKIS

SEQ ID NO: 218 - DNA, 369 bp, Artificial sequence
  Synthetic
atgggagtgcaggtggaaaccatctccccaggagacgggcgcaccttccccaagcgcggccagacctgcgtggtgcactacaccgggatgcttgaagatggaaagaaatttgattcctcccgggacagaaacaagccctttaagtttatgctaggcaagcaggaggtgatccgaggctgggaagaaggggttgcccagatgagtgtgggtcagagagccaaactgactatatctccagattatgcctatggtgccactgggcacccaggcatcatcccaccacatgccactctcgtcttcgatgtggagcttctaaaactggaaggtggttcaggtggtggcgggagcggtggctcgagcagcggtgga

SEQ ID NO: 219 - protein, 123 aa, Artificial sequence
  Synthetic
MGVQVETISPGDGRTFPKRGQTCVVHYTGMLEDGKKFDSSRDRNKPFKFMLGKQEVIRGWEEGVAQMSVGQRAKLTISPDYAYGATGHPGIIPPHATLVFDVELLKLEGGSGGGGSGGSSSGG

SEQ ID NO: 220 - protein, 12 aa, Artificial sequence
  Synthetic
GSMLFRVTINSV

SEQ ID NO: 221 - protein, 13 aa, Artificial sequence
  Synthetic
GSMLFRVTINSVS

SEQ ID NO: 222 - protein, 12 aa, Artificial sequence
  Synthetic
MLFRVTINSVSG

SEQ ID NO: 223 - protein, 13 aa, Artificial sequence
  Synthetic
MLFRVTINSVSGW

SEQ ID NO: 224 - protein, 14 aa, Artificial sequence
  Synthetic
MLFRVTINSVSGWK

SEQ ID NO: 225 - protein, 14 aa, Artificial sequence
  Synthetic
MLFRVTINSVSGWR

SEQ ID NO: 226 - protein, 14 aa, Artificial sequence
  Synthetic
GSMLFRVTINSVSG

SEQ ID NO: 227 - protein, 15 aa, Artificial sequence
  Synthetic
GSMLFRVTINSVSGW

SEQ ID NO: 228 - protein, 16 aa, Artificial sequence
  Synthetic
GSMLFRVTINSVSGWR

SEQ ID NO: 229 - protein, 16 aa, Artificial sequence
  Synthetic
GSMLFRVTINSVSGWK

SEQ ID NO: 230 - protein, 11 aa, Artificial sequence
  Synthetic
GSMLFRVTIWK

SEQ ID NO: 231 - protein, 13 aa, Artificial sequence
  Synthetic
GSMLFRVTINSWK

SEQ ID NO: 232 - protein, 11 aa, Artificial sequence
  Synthetic
MLFRVTINSWK

SEQ ID NO: 233 - protein, 11 aa, Artificial sequence
  Synthetic
MLFRVTINSWS

SEQ ID NO: 234 - protein, 9 aa, Artificial sequence
  Synthetic
MLFRVTIWS

SEQ ID NO: 235 - protein, 9 aa, Artificial sequence
  Synthetic
MLFRVTIWK

SEQ ID NO: 236 - protein, 9 aa, Artificial sequence
  Synthetic
MLFRVKINS

SEQ ID NO: 237 - protein, 13 aa, Artificial sequence
  Synthetic
GSMLFRVTINSWS

SEQ ID NO: 238 - protein, 11 aa, Artificial sequence
  Synthetic
GSMLFRVKINS

SEQ ID NO: 239 - protein, 11 aa, Artificial sequence
  Synthetic
GSMLFRVTIWS

SEQ ID NO: 240 - protein, 9 aa, Artificial sequence
  Synthetic
MLFRVNINS

SEQ ID NO: 241 - protein, 9 aa, Artificial sequence
  Synthetic
MLFRVWINS

SEQ ID NO: 242 - protein, 9 aa, Artificial sequence
  Synthetic
LLFRVKINS

SEQ ID NO: 243 - protein, 9 aa, Artificial sequence
  Synthetic
FLFRVTINS

SEQ ID NO: 244 - protein, 17 aa, Artificial sequence
  Synthetic
SSWKRGSMLFRVTINSV

SEQ ID NO: 245 - protein, 18 aa, Artificial sequence
  Synthetic
SSWKRGSMLFRVTINSVS

SEQ ID NO: 246 - protein, 17 aa, Artificial sequence
  Synthetic
SSWKRMLFRVTINSVSG

SEQ ID NO: 247 - protein, 18 aa, Artificial sequence
  Synthetic
SSWKRMLFRVTINSVSGW

SEQ ID NO: 248 - protein, 19 aa, Artificial sequence
  Synthetic
SSWKRMLFRVTINSVSGWR

SEQ ID NO: 249 - protein, 19 aa, Artificial sequence
  Synthetic
SSWKRMLFRVTINSVSGWK

SEQ ID NO: 250 - protein, 14 aa, Artificial sequence
  Synthetic
MLFRVTINSVSGWK

SEQ ID NO: 251 - protein, 19 aa, Artificial sequence
  Synthetic
SSWKRGSMLFRVTINSVSG

SEQ ID NO: 252 - protein, 20 aa, Artificial sequence
  Synthetic
SSWKRGSMLFRVTINSVSGW

SEQ ID NO: 253 - protein, 21 aa, Artificial sequence
  Synthetic
SSWKRGSMLFRVTINSVSGWR

SEQ ID NO: 254 - protein, 21 aa, Artificial sequence
  Synthetic
SSWKRGSMLFRVTINSVSGWK

SEQ ID NO: 255 - protein, 16 aa, Artificial sequence
  Synthetic
SSWKRGSYLFRVTINS

SEQ ID NO: 256 - protein, 16 aa, Artificial sequence
  Synthetic
SSWKRGSMLFRVKINS

SEQ ID NO: 257 - protein, 16 aa, Artificial sequence
  Synthetic
SSWKRGSMLFRVRINS

SEQ ID NO: 258 - protein, 16 aa, Artificial sequence
  Synthetic
SSWKRGSMLFRVWINS

SEQ ID NO: 259 - protein, 16 aa, Artificial sequence
  Synthetic
SSKRGSMLFRVTIWSV

SEQ ID NO: 260 - protein, 17 aa, Artificial sequence
  Synthetic
SSKRGSMLFRVTIWSVS

SEQ ID NO: 261 - protein, 15 aa, Artificial sequence
  Synthetic
SSWRGSMLFRVTIKS

SEQ ID NO: 262 - protein, 15 aa, Artificial sequence
  Synthetic
KRSSGSMLFRVTIWS

SEQ ID NO: 263 - protein, 13 aa, Artificial sequence
  Synthetic
SSKRMLFRVTIWS

SEQ ID NO: 264 - protein, 13 aa, Artificial sequence
  Synthetic
KRSSMLFRVTIWS

SEQ ID NO: 265 - protein, 13 aa, Artificial sequence
  Synthetic
GSMKFRVTINSWK

SEQ ID NO: 266 - protein, 13 aa, Artificial sequence
  Synthetic
GSMLFRKTINSWK

SEQ ID NO: 267 - protein, 13 aa, Artificial sequence
  Synthetic
GSMLFRVTKNSWK

SEQ ID NO: 268 - protein, 13 aa, Artificial sequence
  Synthetic
GKMLFRVTINSWK

SEQ ID NO: 269 - protein, 11 aa, Artificial sequence
  Synthetic
GKMLFRVTIWK

SEQ ID NO: 270 - protein, 13 aa, Artificial sequence
  Synthetic
GSMKFRVTINSWK

SEQ ID NO: 271 - protein, 11 aa, Artificial sequence
  Synthetic
GSMKFRVTIWK

SEQ ID NO: 272 - protein, 13 aa, Artificial sequence
  Synthetic
GRMLFRVTINSWK

SEQ ID NO: 273 - protein, 11 aa, Artificial sequence
  Synthetic
GRMLFRVTIWK

SEQ ID NO: 274 - protein, 13 aa, Artificial sequence
  Synthetic
GSMRFRVTINSWK

SEQ ID NO: 275 - protein, 11 aa, Artificial sequence
  Synthetic
GSMRFRVTIWK

SEQ ID NO: 276 - protein, 13 aa, Artificial sequence
  Synthetic
GDMLFRVTINSWK

SEQ ID NO: 277 - protein, 11 aa, Artificial sequence
  Synthetic
GDMLFRVTIWK

SEQ ID NO: 278 - protein, 13 aa, Artificial sequence
  Synthetic
GSMDFRVTINSWK

SEQ ID NO: 279 - protein, 11 aa, Artificial sequence
  Synthetic
GSMDFRVTIWK

SEQ ID NO: 280 - protein, 13 aa, Artificial sequence
  Synthetic
GEMLFRVTINSWK

SEQ ID NO: 281 - protein, 13 aa, Artificial sequence
  Synthetic
GSMEFRVTINSWK

SEQ ID NO: 282 - protein, 11 aa, Artificial sequence
  Synthetic
GSMEFRVTIWK

SEQ ID NO: 283 - protein, 13 aa, Artificial sequence
  Synthetic
GSMLFRVTIWKVK

SEQ ID NO: 284 - protein, 13 aa, Artificial sequence
  Synthetic
GSMLFRVTIWSVK

SEQ ID NO: 285 - protein, 12 aa, Artificial sequence
  Synthetic
GSMLFRVTIWSK

SEQ ID NO: 286 - protein, 13 aa, Artificial sequence
  Synthetic
GSMLFRVTIWKWK

SEQ ID NO: 287 - protein, 12 aa, Artificial sequence
  Synthetic
GSMLFRVTIWKK

SEQ ID NO: 288 - protein, 11 aa, Artificial sequence
  Synthetic
GSMLFRVTINS

SEQ ID NO: 289 - protein, 9 aa, Artificial sequence
  Synthetic
MLFRVTINS

SEQ ID NO: 290 - protein, 9 aa, Artificial sequence
  Synthetic
MLFVTINSV

SEQ ID NO: 291 - protein, 11 aa, Artificial sequence
  Synthetic
MLFRVTINSVS

SEQ ID NO: 292 - protein, 10 aa, Artificial sequence
  Synthetic
GSMLFRVTIN

SEQ ID NO: 293 - protein, 9 aa, Artificial sequence
  Synthetic
GSMLFRVTI

SEQ ID NO: 294 - protein, 9 aa, Artificial sequence
  Synthetic
SMLFRVTIN

SEQ ID NO: 295 - protein, 8 aa, Artificial sequence
  Synthetic
MLFRVTIN

SEQ ID NO: 296 - protein, 7 aa, Artificial sequence
  Synthetic
MLFRVTI

SEQ ID NO: 297 - protein, 15 aa, Artificial sequence
  Synthetic
SSKRGSMLFRVTIWS

SEQ ID NO: 298 - protein, 23 aa, Artificial sequence
  Synthetic
GSMLFRVTINSGVSGWALFKKIS

SEQ ID NO: 299 - protein, 23 aa, Artificial sequence
  Synthetic
GSMLFRVTINSGVSGWRLFKKIS

SEQ ID NO: 300 - protein, 11 aa, Artificial sequence
  Synthetic
VSGWALFKKIS

SEQ ID NO: 301 - protein, 25 aa, Artificial sequence
  Synthetic
GSMLFRVTINSVSGVSGWRLFKKIS

SEQ ID NO: 302 - protein, 148 aa, Artificial sequence
  Synthetic
MVFTLDDFVGDWEQTAAYNLDQVLEQGGVSSLLQNLAVSVTPIMRIVRSGENALKIDIHVIIPYEGLSADQMAQIEEVFKVVYPVDDHHFKVILPYGTLVIDGVTPNKLNYFGRPYEGIAVFDGKKITTTGTLWNGNKIIDERLITPD

SEQ ID NO: 303 - DNA, 444 bp, Artificial sequence
  Synthetic
atggtcttcacactcgacgatttcgttggggactgggaacagacagccgcctacaacctggaccaagtccttgaacagggaggtgtgtccagtttgctgcagaatctcgccgtgtccgtaactccgatcatgaggattgtccggagcggtgaaaatgccctgaagatcgacatccatgtcatcatcccgtatgaaggtctgagcgccgaccaaatggcccagatcgaagaggtgtttaaggtggtgtaccctgtggatgatcatcactttaaggtgatcctgccctatggcacactggtaatcgacggggttacgccgaacaagctgaactatttcggacggccgtatgaaggcatcgccgtgttcgacggcaaaaagatcactaccacagggaccctgtggaacggcaacaaaattatcgacgagcgcctgatcacccccgac

SEQ ID NO: 304 - protein, 148 aa, Artificial sequence; identical to SEQ ID NO: 21
  Synthetic

SEQ ID NO: 305 - DNA, 444 bp, Artificial sequence; identical to SEQ ID NO: 18
  Synthetic

SEQ ID NO: 306 - protein, 12 aa, Artificial sequence
  Synthetic
SVSGWRLFKKIS

SEQ ID NO: 307 - protein, 13 aa, Artificial sequence
  Synthetic
NSVSGWRLFKKIS

SEQ ID NO: 308 - protein, 9 aa, Artificial sequence
  Synthetic
GWRLFKKIS

SEQ ID NO: 309 - protein, 23 aa, Artificial sequence
  Synthetic
GSMLFRVTINSGVSGWRLFKKIS

SEQ ID NO: 310 - protein, 13 aa, Artificial sequence
  Synthetic
GSMLFRVTINSWK

SEQ ID NO: 311 - protein, 13 aa, Artificial sequence
  Synthetic
GSMLFRVTINSWK

SEQ ID NO: 312 - protein, 13 aa, Artificial sequence
  Synthetic
GSMLFRVTINSWK

SEQ ID NO: 313 - protein, 13 aa, Artificial sequence
  Synthetic
GSMLFRVTINKWK

SEQ ID NO: 314 - protein, 13 aa, Artificial sequence
  Synthetic
GSMLFRVTIKSWK

SEQ ID NO: 315 - protein, 13 aa, Artificial sequence
  Synthetic
GSMLFRVTINRWK

SEQ ID NO: 316 - protein, 13 aa, Artificial sequence
  Synthetic
GSMLFRVTIRSWK

SEQ ID NO: 317 - protein, 13 aa, Artificial sequence
  Synthetic
GSMLFRVTINDWK

SEQ ID NO: 318 - protein, 13 aa, Artificial sequence
  Synthetic
GSMLFRVTIDSWK

SEQ ID NO: 319 - protein, 13 aa, Artificial sequence
  Synthetic
GSMLFRVTINEWK

SEQ ID NO: 320 - protein, 13 aa, Artificial sequence
  Synthetic
GSMLFRVTIESWK

SEQ ID NO: 321 - protein, 13 aa, Artificial sequence
  Synthetic
GSMRFRVTINSWK

SEQ ID NO: 322 - protein, 13 aa, Artificial sequence
  Synthetic
GSMDFRVTINSWK

SEQ ID NO: 323 - protein, 13 aa, Artificial sequence
  Synthetic
GSMEFRVTINSWK

SEQ ID NO: 324 - protein, 13 aa, Artificial sequence
  Synthetic
GSMLFRRTINSWK

SEQ ID NO: 325 - protein, 13 aa, Artificial sequence
  Synthetic
GSMLFRDTINSWK

SEQ ID NO: 326 - protein, 13 aa, Artificial sequence
  Synthetic
GSMLFRETINSWK

SEQ ID NO: 327 - protein, 13 aa, Artificial sequence
  Synthetic
GSMLFRVTDNSWK

SEQ ID NO: 328 - protein, 13 aa, Artificial sequence
  Synthetic
GSMLFRVTENSWK

SEQ ID NO: 329 - protein, 13 aa, Artificial sequence
  Synthetic
GSMKFRVTINSWK

SEQ ID NO: 330 - protein, 13 aa, Artificial sequence
  Synthetic
GSMLFRKTINSWK

SEQ ID NO: 331 - protein, 13 aa, Artificial sequence
  Synthetic
GSMLFRVTKNSWK

SEQ ID NO: 332 - protein, 11 aa, Artificial sequence
  Synthetic
GSMLFRVTINS

SEQ ID NO: 333 - protein, 11 aa, Artificial sequence
  Synthetic
GSMLFRVSINS

SEQ ID NO: 334 - protein, 11 aa, Artificial sequence
  Synthetic
GSMLFRVNINS

SEQ ID NO: 335 - protein, 11 aa, Artificial sequence
  Synthetic
GSKLFRVTINS

SEQ ID NO: 336 - protein, 11 aa, Artificial sequence
  Synthetic
GSRLFRVTINS

SEQ ID NO: 337 - protein, 11 aa, Artificial sequence
  Synthetic
GSMWFRVTINS

SEQ ID NO: 338 - protein, 11 aa, Artificial sequence
  Synthetic
GSMSFRVTINS

SEQ ID NO: 339 - protein, 11 aa, Artificial sequence
  Synthetic
GSMNFRVTINS

SEQ ID NO: 340 - protein, 11 aa, Artificial sequence
  Synthetic
GSMKFRVTINS

SEQ ID NO: 341 - protein, 11 aa, Artificial sequence
  Synthetic
GSMLFRWTINS

SEQ ID NO: 342 - protein, 11 aa, Artificial sequence
  Synthetic
GSMLFRSTINS

SEQ ID NO: 343 - protein, 11 aa, Artificial sequence
  Synthetic
GSMLFRNTINS

SEQ ID NO: 344 - protein, 11 aa, Artificial sequence
  Synthetic
GSMLFRKTINS

SEQ ID NO: 345 - protein, 11 aa, Artificial sequence
  Synthetic
GSMLFRVTWNS

SEQ ID NO: 346 - protein, 11 aa, Artificial sequence
  Synthetic
GSMLFRVTSNS

SEQ ID NO: 347 - protein, 11 aa, Artificial sequence
  Synthetic
GSMLFRVTNNS

SEQ ID NO: 348 - protein, 11 aa, Artificial sequence
  Synthetic
GSMLFRVTKNS

SEQ ID NO: 349 - protein, 11 aa, Artificial sequence
  Synthetic
GSMLFRVTIKS

SEQ ID NO: 350 - protein, 634 aa, Artificial sequence
  Synthetic
MKHHHHHHVSKGEELIKENMRSKLYLEGSVNGHQFKCTHEGEGKPYEGKQTNRIKVVEGGPLPFAFDILATHFMYGSKVFIKYPADLPDYFKQSFPEGFTWERVMVFEDGGVLTATQDTSLQDGELIYNVKVRGVNFPANGPVMQKKTLGWEPSTETMYPADGGLEGRCDKALKLVGGGHLHVNFKTTYKSKKPVKMPGVHYVDRRLERIKEADNETYVEQYEHAVARYSNLGGGFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTINGVTGWRLCERILARHELIKENMRSKLYLEGSVNGHQFKCTHEGEGKPYEGKQTNRIKVVEGGPLPFAFDILATHFMYGSKVFIKYPADLPDYFKQSFPEGFTWERVMVFEDGGVLTATQDTSLQDGELIYNVKVRGVNFPANGPVMQKKTLGWEPSTETMYPADGGLEGRCDKALKLVGGGHLHVNFKTTYKSKKPVKMPGVHYVDRRLERIKEADNETYVEQYEHAVARYSNLGGGMDELYK

SEQ ID NO: 351 - DNA, 1902 bp, Artificial sequence
  Synthetic
atgaaacatcaccatcaccatcatgtgagcaagggagaagaacttataaaagaaaacatgcggtctaaactgtacctcgagggctccgtcaatgggcaccagtttaagtgtacccacgagggtgagggaaagccctatgaggggaagcagacaaaccgcatcaaggtcgtcgaagggggacccctcccgtttgcctttgatatcttggctactcactttatgtacggaagcaaagttttcataaagtatcctgccgaccttcctgattattttaaacagtcatttcccgagggtttcacatgggaaagggtcatggtgtttgaggatggaggcgtgctcactgcaactcaggacacctcactgcaggacggcgagctgatctacaatgtgaaggtccggggtgtaaacttccctgccaacgggcctgtaatgcagaagaagaccctgggatgggagccgtccaccgaaaccatgtaccctgctgatggtgggctggagggccgatgtgacaaggctctgaagctcgttggaggtggtcatttgcacgtaaatttcaagacaacttacaagagcaaaaaacccgtaaaaatgcccggggttcattacgttgacagaaggcttgaacgcataaaggaagctgataacgagacatacgtggagcagtacgagcacgccgttgcccggtactcaaacctggggggtggctttacactggaggattttgtgggagattggagacagacagccggctacaatctggatcaggtgctggaacaaggaggagtgtcttctctgtttcagaatctgggagtgagcgtgacacctatccagaggatcgtgctgtctggcgagaatggactgaagatcgatattcacgtgatcatcccctacgaaggcctgtctggagaccagatgggccagattgagaagatcttcaaagtggtgtatcctgtggacgatcaccacttcaaggtgatcctgcactacggcaccctggtgattgatggagtgacacctaacatgatcgactacttcggaagaccttacgagggaatcgccgtgttcgacggaaagaagatcaccgtgacaggaacactgtggaatggaaacaagatcatcgacgagcggctgatcaaccctgatggatctctgctgttcagagtgaccatcaacggagtgacaggatggagactgtgcgagagaattctggctagacatgagctaatcaaggaaaatatgagaagtaagctatacttagaggggtccgtcaacggtcaccagtttaaatgcactcatgaaggtgaggggaaaccttatgaaggtaagcagactaatcgaataaaagtggtcgagggcggtcctctgccattcgctttcgatattctggccactcactttatgtatgggtctaaggtctttattaaataccccgctgatttgccagactactttaaacagtccttccctgaaggattcacatgggagcgggtgatggtgttcgaggatggaggcgttcttactgcaactcaggatacttccttgcaagacggggaactgatctacaacgttaaggtccgcggcgtcaatttcccagccaatggtccagtgatgcagaagaaaaccttggggtgggagccctcaacggagacaatgtaccctgcggacggcgggcttgagggtagatgtgataaggcattgaaactcgtcgggggcggccaccttcatgtgaatttcaagactacatataaaagtaaaaaaccagtcaagatgcctggagtgcactacgtggatcgtaggttggagaggataaaagaagccgacaacgaaacttatgtagagcaatatgagcacgccgtggctcgttattccaacttgggcggaggaatggatgaactgtacaag

SEQ ID NO: 352 - protein, 622 aa, Artificial sequence
  Synthetic
MKHHHHHHVSKGEELIKENMRSKLYLEGSVNGHQFKCTHEGEGKPYEGKQTNRIKVVEGGPLPFAFDILATHFMYGSKVFIKYPADLPDYFKQSFPEGFTWERVMVFEDGGVLTATQDTSLQDGELIYNVKVRGVNFPANGPVMQKKTLGWEPSTETMYPADGGLEGRCDKALKLVGGGHLHVNFKTTYKSKKPVKMPGVHYVDRRLERIKEADNETYVEQYEHAVARYSNLGGGFTLEDFVGDWEQTAAYNLDQVLEQGGVSSLLQNLAVSVTPIQRIVRSGENALKIDIHVIIPYEGLSADQMAQIEEVFKVVYPVDDHHFKVILPYGTLVIDGVTPNMLNYFGRPYEGIAVFDGKKITVTGTLWNGNKIIDERLITPDGSMLFRVTINSRHELIKENMRSKLYLEGSVNGHQFKCTHEGEGKPYEGKQTNRIKVVEGGPLPFAFDILATHFMYGSKVFIKYPADLPDYFKQSFPEGFTWERVMVFEDGGVLTATQDTSLQDGELIYNVKVRGVNFPANGPVMQKKTLGWEPSTETMYPADGGLEGRCDKALKLVGGGHLHVNFKTTYKSKKPVKMPGVHYVDRRLERIKEADNETYVEQYEHAVARYSNLGGGMDELYK

SEQ ID NO: 353 - DNA, 1866 bp, Artificial sequence
  Synthetic
atgaaacatcaccatcaccatcatgtgagcaagggagaagaacttataaaagaaaacatgcggtctaaactgtacctcgagggctccgtcaatgggcaccagtttaagtgtacccacgagggtgagggaaagccctatgaggggaagcagacaaaccgcatcaaggtcgtcgaagggggacccctcccgtttgcctttgatatcttggctactcactttatgtacggaagcaaagttttcataaagtatcctgccgaccttcctgattattttaaacagtcatttcccgagggtttcacatgggaaagggtcatggtgtttgaggatggaggcgtgctcactgcaactcaggacacctcactgcaggacggcgagctgatctacaatgtgaaggtccggggtgtaaacttccctgccaacgggcctgtaatgcagaagaagaccctgggatgggagccgtccaccgaaaccatgtaccctgctgatggtgggctggagggccgatgtgacaaggctctgaagctcgttggaggtggtcatttgcacgtaaatttcaagacaacttacaagagcaaaaaacccgtaaaaatgcccggggttcattacgttgacagaaggcttgaacgcataaaggaagctgataacgagacatacgtggagcagtacgagcacgccgttgcccggtactcaaacctggggggtggcttcacactcgaagatttcgttggggactgggaacagacagccgcctacaacctggaccaagtccttgaacagggaggtgtgtccagtttgctgcagaatctcgccgtgtccgtaactccgatccaaaggattgtccggagcggtgaaaatgccctgaagatcgacatccatgtcatcatcccgtatgaaggtctgagcgccgaccaaatggcccagatcgaagaggtgtttaaggtggtgtaccctgtggatgatcatcactttaaggtgatcctgccctatggcacactggtaatcgacggggttacgccgaacatgctgaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacagcagacatgagctaatcaaggaaaatatgagaagtaagctatacttagaggggtccgtcaacggtcaccagtttaaatgcactcatgaaggtgaggggaaaccttatgaaggtaagcagactaatcgaataaaagtggtcgagggcggtcctctgccattcgctttcgatattctggccactcactttatgtatgggtctaaggtctttattaaataccccgctgatttgccagactactttaaacagtccttccctgaaggattcacatgggagcgggtgatggtgttcgaggatggaggcgttcttactgcaactcaggatacttccttgcaagacggggaactgatctacaacgttaaggtccgcggcgtcaatttcccagccaatggtccagtgatgcagaagaaaaccttggggtgggagccctcaacggagacaatgtaccctgcggacggcgggcttgagggtagatgtgataaggcattgaaactcgtcgggggcggccaccttcatgtgaatttcaagactacatataaaagtaaaaaaccagtcaagatgcctggagtgcactacgtggatcgtaggttggagaggataaaagaagccgacaacgaaacttatgtagagcaatatgagcacgccgtggctcgttattccaacttgggcggaggaatggatgaactgtacaag

SEQ ID NO: 354 - protein, 611 aa, Artificial sequence
  Synthetic
MKHHHHHHVSKGEELIKENMRSKLYLEGSVNGHQFKCTHEGEGKPYEGKQTNRIKVVEGGPLPFAFDILATHFMYGSKVFIKYPADLPDYFKQSFPEGFTWERVMVFEDGGVLTATQDTSLQDGELIYNVKVRGVNFPANGPVMQKKTLGWEPSTETMYPADGGLEGRCDKALKLVGGGHLHVNFKTTYKSKKPVKMPGVHYVDRRLERIKEADNETYVEQYEHAVARYSNLGGGFTLDDFVGDWEQTAAYNLDQVLEQGGVSSLLQNLAVSVTPIMRIVRSGENALKIDIHVIIPYEGLSADQMAQIEEVFKVVYPVDDHHFKVILPYGTLVIDGVTPNKLNYFGRPYEGIAVFDGKKITTTGTLWNGNKIIDERLITPDRHELIKENMRSKLYLEGSVNGHQFKCTHEGEGKPYEGKQTNRIKVVEGGPLPFAFDILATHFMYGSKVFIKYPADLPDYFKQSFPEGFTWERVMVFEDGGVLTATQDTSLQDGELIYNVKVRGVNFPANGPVMQKKTLGWEPSTETMYPADGGLEGRCDKALKLVGGGHLHVNFKTTYKSKKPVKMPGVHYVDRRLERIKEADNETYVEQYEHAVARYSNLGGGMDELYK

SEQ ID NO: 355 - DNA, 1833 bp, Artificial sequence
  Synthetic
atgaaacatcaccatcaccatcatgtgagcaagggagaagaacttataaaagaaaacatgcggtctaaactgtacctcgagggctccgtcaatgggcaccagtttaagtgtacccacgagggtgagggaaagccctatgaggggaagcagacaaaccgcatcaaggtcgtcgaagggggacccctcccgtttgcctttgatatcttggctactcactttatgtacggaagcaaagttttcataaagtatcctgccgaccttcctgattattttaaacagtcatttcccgagggtttcacatgggaaagggtcatggtgtttgaggatggaggcgtgctcactgcaactcaggacacctcactgcaggacggcgagctgatctacaatgtgaaggtccggggtgtaaacttccctgccaacgggcctgtaatgcagaagaagaccctgggatgggagccgtccaccgaaaccatgtaccctgctgatggtgggctggagggccgatgtgacaaggctctgaagctcgttggaggtggtcatttgcacgtaaatttcaagacaacttacaagagcaaaaaacccgtaaaaatgcccggggttcattacgttgacagaaggcttgaacgcataaaggaagctgataacgagacatacgtggagcagtacgagcacgccgttgcccggtactcaaacctggggggtggcttcacactcgacgatttcgttggggactgggaacagacagccgcctacaacctggaccaagtccttgaacagggaggtgtgtccagtttgctgcagaatctcgccgtgtccgtaactccgatcatgaggattgtccggagcggtgaaaatgccctgaagatcgacatccatgtcatcatcccgtatgaaggtctgagcgccgaccaaatggcccagatcgaagaggtgtttaaggtggtgtaccctgtggatgatcatcactttaaggtgatcctgccctatggcacactggtaatcgacggggttacgccgaacaagctgaactatttcggacggccgtatgaaggcatcgccgtgttcgacggcaaaaagatcactaccacagggaccctgtggaacggcaacaaaattatcgacgagcgcctgatcacccccgacagacatgagctaatcaaggaaaatatgagaagtaagctatacttagaggggtccgtcaacggtcaccagtttaaatgcactcatgaaggtgaggggaaaccttatgaaggtaagcagactaatcgaataaaagtggtcgagggcggtcctctgccattcgctttcgatattctggccactcactttatgtatgggtctaaggtctttattaaataccccgctgatttgccagactactttaaacagtccttccctgaaggattcacatgggagcgggtgatggtgttcgaggatggaggcgttcttactgcaactcaggatacttccttgcaagacggggaactgatctacaacgttaaggtccgcggcgtcaatttcccagccaatggtccagtgatgcagaagaaaaccttggggtgggagccctcaacggagacaatgtaccctgcggacggcgggcttgagggtagatgtgataaggcattgaaactcgtcgggggcggccaccttcatgtgaatttcaagactacatataaaagtaaaaaaccagtcaagatgcctggagtgcactacgtggatcgtaggttggagaggataaaagaagccgacaacgaaacttatgtagagcaatatgagcacgccgtggctcgttattccaacttgggcggaggaatggatgaactgtacaag

SEQ ID NO: 356 - protein, 401 aa, Artificial sequence
  Synthetic
MKHHHHHHFTLEDFVGDWEQTAAYNLDQVLEQGGVSSLLQNLAVSVTPIQRIVRSGENALKIDIHVIIPYEGLSADQMAQIEEVFKVVYPVDDHHFKVILPYGTLVIDGVTPNMLNYFGRPYEGIAVFDGKKITVTGTLWNGNKIIDERLITPDGSMLFRVTINSGGSGGSSGELIKENMRSKLYLEGSVNGHQFKCTHEGEGKPYEGKQTNRIKVVEGGPLPFAFDILATHFMYGSKVFIKYPADLPDYFKQSFPEGFTWERVMVFEDGGVLTATQDTSLQDGELIYNVKVRGVNFPANGPVMQKKTLGWEPSTETMYPADGGLEGRCDKALKLVGGGHLHVNFKTTYKSKKPVKMPGVHYVDRRLERIKEADNETYVEQYEHAVARYSNLGGGMDELYK

SEQ ID NO: 357 - DNA, 1203 bp, Artificial sequence
  Synthetic
atgaaacatcaccatcaccatcatttcacactcgaagatttcgttggggactgggaacagacagccgcctacaacctggaccaagtccttgaacagggaggtgtgtccagtttgctgcagaatctcgccgtgtccgtaactccgatccaaaggattgtccggagcggtgaaaatgccctgaagatcgacatccatgtcatcatcccgtatgaaggtctgagcgccgaccaaatggcccagatcgaagaggtgtttaaggtggtgtaccctgtggatgatcatcactttaaggtgatcctgccctatggcacactggtaatcgacggggttacgccgaacatgctgaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacagcggaggctcaggtggatcctcaggtgagctaatcaaggaaaatatgagaagtaagctatacttagaggggtccgtcaacggtcaccagtttaaatgcactcatgaaggtgaggggaaaccttatgaaggtaagcagactaatcgaataaaagtggtcgagggcggtcctctgccattcgctttcgatattctggccactcactttatgtatgggtctaaggtctttattaaataccccgctgatttgccagactactttaaacagtccttccctgaaggattcacatgggagcgggtgatggtgttcgaggatggaggcgttcttactgcaactcaggatacttccttgcaagacggggaactgatctacaacgttaaggtccgcggcgtcaatttcccagccaatggtccagtgatgcagaagaaaaccttggggtgggagccctcaacggagacaatgtaccctgcggacggcgggcttgagggtagatgtgataaggcattgaaactcgtcgggggcggccaccttcatgtgaatttcaagactacatataaaagtaaaaaaccagtcaagatgcctggagtgcactacgtggatcgtaggttggagaggataaaagaagccgacaacgaaacttatgtagagcaatatgagcacgccgtggctcgttattccaacttgggcggaggaatggatgaactgtacaag

SEQ ID NO: 358 - protein, 395 aa, Artificial sequence
  Synthetic
MKHHHHHHFTLEDFVGDWEQTAAYNLDQVLEQGGVSSLLQNLAVSVTPIQRIVRSGENALKIDIHVIIPYEGLSADQMAQIEEVFKVVYPVDDHHFKVILPYGTLVIDGVTPNMLNYFGRPYEGIAVFDGKKITVTGTLWNGNKIIDERLITPDGSMLFRVTINSRHELIKENMRSKLYLEGSVNGHQFKCTHEGEGKPYEGKQTNRIKVVEGGPLPFAFDILATHFMYGSKVFIKYPADLPDYFKQSFPEGFTWERVMVFEDGGVLTATQDTSLQDGELIYNVKVRGVNFPANGPVMQKKTLGWEPSTETMYPADGGLEGRCDKALKLVGGGHLHVNFKTTYKSKKPVKMPGVHYVDRRLERIKEADNETYVEQYEHAVARYSNLGGGMDELYK

SEQ ID NO: 359 - DNA, 1185 bp, Artificial sequence
  Synthetic
atgaaacatcaccatcaccatcatttcacactcgaagatttcgttggggactgggaacagacagccgcctacaacctggaccaagtccttgaacagggaggtgtgtccagtttgctgcagaatctcgccgtgtccgtaactccgatccaaaggattgtccggagcggtgaaaatgccctgaagatcgacatccatgtcatcatcccgtatgaaggtctgagcgccgaccaaatggcccagatcgaagaggtgtttaaggtggtgtaccctgtggatgatcatcactttaaggtgatcctgccctatggcacactggtaatcgacggggttacgccgaacatgctgaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacagcagacatgagctaatcaaggaaaatatgagaagtaagctatacttagaggggtccgtcaacggtcaccagtttaaatgcactcatgaaggtgaggggaaaccttatgaaggtaagcagactaatcgaataaaagtggtcgagggcggtcctctgccattcgctttcgatattctggccactcactttatgtatgggtctaaggtctttattaaataccccgctgatttgccagactactttaaacagtccttccctgaaggattcacatgggagcgggtgatggtgttcgaggatggaggcgttcttactgcaactcaggatacttccttgcaagacggggaactgatctacaacgttaaggtccgcggcgtcaatttcccagccaatggtccagtgatgcagaagaaaaccttggggtgggagccctcaacggagacaatgtaccctgcggacggcgggcttgagggtagatgtgataaggcattgaaactcgtcgggggcggccaccttcatgtgaatttcaagactacatataaaagtaaaaaaccagtcaagatgcctggagtgcactacgtggatcgtaggttggagaggataaaagaagccgacaacgaaacttatgtagagcaatatgagcacgccgtggctcgttattccaacttgggcggaggaatggatgaactgtacaag

SEQ ID NO: 360 - protein, 390 aa, Artificial sequence
  Synthetic
MKHHHHHHFTLDDFVGDWEQTAAYNLDQVLEQGGVSSLLQNLAVSVTPIMRIVRSGENALKIDIHVIIPYEGLSADQMAQIEEVFKVVYPVDDHHFKVILPYGTLVIDGVTPNKLNYFGRPYEGIAVFDGKKITTTGTLWNGNKIIDERLITPDGGSGGSSGELIKENMRSKLYLEGSVNGHQFKCTHEGEGKPYEGKQTNRIKVVEGGPLPFAFDILATHFMYGSKVFIKYPADLPDYFKQSFPEGFTWERVMVFEDGGVLTATQDTSLQDGELIYNVKVRGVNFPANGPVMQKKTLGWEPSTETMYPADGGLEGRCDKALKLVGGGHLHVNFKTTYKSKKPVKMPGVHYVDRRLERIKEADNETYVEQYEHAVARYSNLGGGMDELYK

SEQ ID NO: 361 - DNA, 1170 bp, Artificial sequence
  Synthetic
atgaaacatcaccatcaccatcatttcacactcgacgatttcgttggggactgggaacagacagccgcctacaacctggaccaagtccttgaacagggaggtgtgtccagtttgctgcagaatctcgccgtgtccgtaactccgatcatgaggattgtccggagcggtgaaaatgccctgaagatcgacatccatgtcatcatcccgtatgaaggtctgagcgccgaccaaatggcccagatcgaagaggtgtttaaggtggtgtaccctgtggatgatcatcactttaaggtgatcctgccctatggcacactggtaatcgacggggttacgccgaacaagctgaactatttcggacggccgtatgaaggcatcgccgtgttcgacggcaaaaagatcactaccacagggaccctgtggaacggcaacaaaattatcgacgagcgcctgatcacccccgacggaggctcaggtggatcctcaggtgagctaatcaaggaaaatatgagaagtaagctatacttagaggggtccgtcaacggtcaccagtttaaatgcactcatgaaggtgaggggaaaccttatgaaggtaagcagactaatcgaataaaagtggtcgagggcggtcctctgccattcgctttcgatattctggccactcactttatgtatgggtctaaggtctttattaaataccccgctgatttgccagactactttaaacagtccttccctgaaggattcacatgggagcgggtgatggtgttcgaggatggaggcgttcttactgcaactcaggatacttccttgcaagacggggaactgatctacaacgttaaggtccgcggcgtcaatttcccagccaatggtccagtgatgcagaagaaaaccttggggtgggagccctcaacggagacaatgtaccctgcggacggcgggcttgagggtagatgtgataaggcattgaaactcgtcgggggcggccaccttcatgtgaatttcaagactacatataaaagtaaaaaaccagtcaagatgcctggagtgcactacgtggatcgtaggttggagaggataaaagaagccgacaacgaaacttatgtagagcaatatgagcacgccgtggctcgttattccaacttgggcggaggaatggatgaactgtacaag

SEQ ID NO: 362 - protein, 384 aa, Artificial sequence
  Synthetic
MKHHHHHHFTLDDFVGDWEQTAAYNLDQVLEQGGVSSLLQNLAVSVTPIMRIVRSGENALKIDIHVIIPYEGLSADQMAQIEEVFKVVYPVDDHHFKVILPYGTLVIDGVTPNKLNYFGRPYEGIAVFDGKKITTTGTLWNGNKIIDERLITPDRHELIKENMRSKLYLEGSVNGHQFKCTHEGEGKPYEGKQTNRIKVVEGGPLPFAFDILATHFMYGSKVFIKYPADLPDYFKQSFPEGFTWERVMVFEDGGVLTATQDTSLQDGELIYNVKVRGVNFPANGPVMQKKTLGWEPSTETMYPADGGLEGRCDKALKLVGGGHLHVNFKTTYKSKKPVKMPGVHYVDRRLERIKEADNETYVEQYEHAVARYSNLGGGMDELYK

SEQ ID NO: 363 - DNA, 1152 bp, Artificial sequence
  Synthetic
atgaaacatcaccatcaccatcatttcacactcgacgatttcgttggggactgggaacagacagccgcctacaacctggaccaagtccttgaacagggaggtgtgtccagtttgctgcagaatctcgccgtgtccgtaactccgatcatgaggattgtccggagcggtgaaaatgccctgaagatcgacatccatgtcatcatcccgtatgaaggtctgagcgccgaccaaatggcccagatcgaagaggtgtttaaggtggtgtaccctgtggatgatcatcactttaaggtgatcctgccctatggcacactggtaatcgacggggttacgccgaacaagctgaactatttcggacggccgtatgaaggcatcgccgtgttcgacggcaaaaagatcactaccacagggaccctgtggaacggcaacaaaattatcgacgagcgcctgatcacccccgacagacatgagctaatcaaggaaaatatgagaagtaagctatacttagaggggtccgtcaacggtcaccagtttaaatgcactcatgaaggtgaggggaaaccttatgaaggtaagcagactaatcgaataaaagtggtcgagggcggtcctctgccattcgctttcgatattctggccactcactttatgtatgggtctaaggtctttattaaataccccgctgatttgccagactactttaaacagtccttccctgaaggattcacatgggagcgggtgatggtgttcgaggatggaggcgttcttactgcaactcaggatacttccttgcaagacggggaactgatctacaacgttaaggtccgcggcgtcaatttcccagccaatggtccagtgatgcagaagaaaaccttggggtgggagccctcaacggagacaatgtaccctgcggacggcgggcttgagggtagatgtgataaggcattgaaactcgtcgggggcggccaccttcatgtgaatttcaagactacatataaaagtaaaaaaccagtcaagatgcctggagtgcactacgtggatcgtaggttggagaggataaaagaagccgacaacgaaacttatgtagagcaatatgagcacgccgtggctcgttattccaacttgggcggaggaatggatgaactgtacaag

SEQ ID NO: 364 - protein, 155 aa, Artificial sequence
  Synthetic
MKHHHHHHVFTLEDFVGDWEQTAAYNLDQVLEQGGVSSLLQNLAVSVTPILRIVRSGENALKIDIHVIIPYEGLSADQMAQIEEVFKVVYPVDDHHFKVILPYGTLVIDGVTPNMLNYFGRPYEGIAVFDGKKITVTGTLWNGNKIIDERLITPD

SEQ ID NO: 365 - DNA, 465 bp, Artificial sequence
  Synthetic
atgaaacatcaccatcaccatcatgtcttcacactcgaagatttcgttggggactgggaacagaccgccgcctacaacctggaccaagtccttgaacagggaggtgtgtccagtttgctgcagaatctcgccgtgtccgtaactccgatcctaaggattgtccggagcggtgaaaatgccctgaagatcgacatccatgtcatcatcccgtatgaaggtctgagcgccgaccaaatggcccagatcgaagaggtgtttaaggtggtgtaccctgtggatgatcatcactttaaggtgatcctgccctatggcacactggtaatcgacggggttacgccgaacatgctgaactatttcggacggccgtatgaaggcatcgccgtgttcgacggcaaaaagatcactgtaacagggaccctgtggaacggcaacaaaattatcgacgagcgcctgatcacccccgac

SEQ ID NO: 366 - protein, 15 aa, Artificial sequence
  Synthetic
WNGNKIIDERLITPD

SEQ ID NO: 367 - protein, 13 aa, Artificial sequence
  Synthetic
KKITTTGTLWNGR

SEQ ID NO: 368 - protein, 12 aa, Artificial sequence
  Synthetic
RPYEGIAVFDGK

SEQ ID NO: 369 - protein, 24 aa, Artificial sequence
  Synthetic
GKMLFRVTIWKVSVSGWRLFKKIS

SEQ ID NO: 370 - protein, 22 aa, Artificial sequence
  Synthetic
GKMLFRVTIWKVSGWRLFKKIS

SEQ ID NO: 371 - protein, 26 aa, Artificial sequence
  Synthetic
GSMKFRVTINSWKVSVSGWRLFKKIS

SEQ ID NO: 372 - protein, 24 aa, Artificial sequence
  Synthetic
GSMKFRVTINSWKVSGWRLFKKIS

SEQ ID NO: 373 - protein, 26 aa, Artificial sequence
  Synthetic
GSMKFRVTINSWKNVTGYRLFKKISN

SEQ ID NO: 374 - protein, 24 aa, Artificial sequence
  Synthetic
GSMKFRVTINSWKVTGYRLFEKIS

SEQ ID NO: 375 - protein, 24 aa, Artificial sequence
  Synthetic
GSMKFRVTIWKVSVSGWRLFKKIS

SEQ ID NO: 376 - protein, 22 aa, Artificial sequence
  Synthetic
GSMKFRVTIWKVSGWRLFKKIS

SEQ ID NO: 377 - protein, 26 aa, Artificial sequence
  Synthetic
GRMLFRVTINSWKVSVSGWRLFKKIS

SEQ ID NO: 378 - protein, 24 aa, Artificial sequence
  Synthetic
GRMLFRVTINSWKVSGWRLFKKIS

SEQ ID NO: 379 - protein, 24 aa, Artificial sequence
  Synthetic
GRMLFRVTIWKVSVSGWRLFKKIS

SEQ ID NO: 380 - protein, 22 aa, Artificial sequence
  Synthetic
GRMLFRVTIWKVSGWRLFKKIS

SEQ ID NO: 381 - protein, 24 aa, Artificial sequence
  Synthetic
GSMLFRVTINSVSVSGWRLFKKIS

SEQ ID NO: 382 - protein, 22 aa, Artificial sequence
  Synthetic
GSMLFKVTINSVSGWRLFKKIS

SEQ ID NO: 383 - protein, 22 aa, Artificial sequence
  Synthetic
GSMLFQVTINSVSGWRLFKKIS

SEQ ID NO: 384 - protein, 22 aa, Artificial sequence
  Synthetic
GSMLFEVTINSVSGWRLFKKIS

SEQ ID NO: 385 - protein, 22 aa, Artificial sequence
  Synthetic
GSMLFNVTINSVSGWRLFKKIS

SEQ ID NO: 386 - protein, 21 aa, Artificial sequence
  Synthetic
GRPYEGIAVFDGKKITTTGTL

SEQ ID NO: 387 - protein, 24 aa, Artificial sequence
  Synthetic
GSMKFRVTINSWKVTGYRLFEKES

SEQ ID NO: 388 - protein, 24 aa, Artificial sequence
  Synthetic
GSMKFRVTINSWKVEGYRLFEKIS

SEQ ID NO: 389 - protein, 24 aa, Artificial sequence
  Synthetic
KKITTTGTLWNGNKIIDERLITPD

SEQ ID NO: 390 - protein, 26 aa, Artificial sequence
  Synthetic
WNGNKIIDERLITPDGSMLFRVTINS

SEQ ID NO: 391 - protein, 13 aa, Artificial sequence
  Synthetic
GKMLFRVTIQKWK

SEQ ID NO: 392 - protein, 13 aa, Artificial sequence
  Synthetic
GKMLFRVTIGKWK

SEQ ID NO: 393 - protein, 13 aa, Artificial sequence
  Synthetic
GKMLFRVTIGRWK

SEQ ID NO: 394 - protein, 13 aa, Artificial sequence
  Synthetic
GKMLFRVTIGNWK

SEQ ID NO: 395 - protein, 13 aa, Artificial sequence
  Synthetic
GKMLFRVTIQNWK

SEQ ID NO: 396 - protein, 13 aa, Artificial sequence
  Synthetic
GKMLFRVTIDKWK

SEQ ID NO: 397 - protein, 13 aa, Artificial sequence
  Synthetic
GKMLFRVTIEKWK

SEQ ID NO: 398 - protein, 13 aa, Artificial sequence
  Synthetic
GKMLFRVTIERWK

SEQ ID NO: 399 - protein, 13 aa, Artificial sequence
  Synthetic
GKMLFRVTIDRWK

SEQ ID NO: 400 - protein, 13 aa, Artificial sequence
  Synthetic
DKMLFRVTIQKWK

SEQ ID NO: 401 - protein, 13 aa, Artificial sequence
  Synthetic
DKMLFRVTIGKWK

SEQ ID NO: 402 - protein, 13 aa, Artificial sequence
  Synthetic
DKMLFRVTIGRWK

SEQ ID NO: 403 - protein, 13 aa, Artificial sequence
  Synthetic
DKMLFRVTIGNWK

SEQ ID NO: 404 - protein, 13 aa, Artificial sequence
  Synthetic
DKMLFRVTIQNWK

SEQ ID NO: 405 - protein, 13 aa, Artificial sequence
  Synthetic
DKMLFRVTIDKWK

SEQ ID NO: 406 - protein, 13 aa, Artificial sequence
  Synthetic
DKMLFRVTIEKWK

SEQ ID NO: 407 - protein, 13 aa, Artificial sequence
  Synthetic
DKMLFRVTIERWK

SEQ ID NO: 408 - protein, 13 aa, Artificial sequence
  Synthetic
DKMLFRVTIDRWK

SEQ ID NO: 409 - protein, 35 aa, Artificial sequence
  Synthetic
RPYEGIAVFDGKKITVTGTLWNGNKIIDERLITPD

SEQ ID NO: 410 - protein, 13 aa, Artificial sequence
  Synthetic
EKMLFRVTIQKWK

SEQ ID NO: 411 - protein, 13 aa, Artificial sequence
  Synthetic
EKMLFRVTIGKWK

SEQ ID NO: 412 - protein, 13 aa, Artificial sequence
  Synthetic
EKMLFRVTIGRWK

SEQ ID NO: 413 - protein, 22 aa, Artificial sequence
  Synthetic
DKMLFTVTIQKVSGWRLFKKIS

SEQ ID NO: 414 - protein, 22 aa, Artificial sequence
  Synthetic
DKLLFTVTIEKVSGWRLFKKIS

SEQ ID NO: 415 - protein, 24 aa, Artificial sequence
  Synthetic
DKLLFTVTIEKWKVSGWRLFKKIS

SEQ ID NO: 416 - protein, 24 aa, Artificial sequence
  Synthetic
DKLLFTVTIEKYKVSGWRLFKKIS

SEQ ID NO: 417 - protein, 26 aa, Artificial sequence
  Synthetic
DKLLFTVTIEKYKVSVSGWRLFKKIS

SEQ ID NO: 418 - protein, 22 aa, Artificial sequence
  Synthetic
KKMLFRVTIQKVSGWRLFKKIS

SEQ ID NO: 419 - protein, 26 aa, Artificial sequence
  Synthetic
KKMLFRVTIQKWKVSVSGWRLFKKIS

SEQ ID NO: 420 - protein, 24 aa, Artificial sequence
  Synthetic
KKMLFRVTIQKWKVSGWRLFKKIS

SEQ ID NO: 421 - protein, 22 aa, Artificial sequence
  Synthetic
DKLLFTVTIGKVSGWRLFKKIS

SEQ ID NO: 422 - protein, 24 aa, Artificial sequence
  Synthetic
DKLLFTVTIGKYKVSGWRLFKKIS

SEQ ID NO: 423 - protein, 26 aa, Artificial sequence
  Synthetic
DKLLFTVTIGKYKVSVSGWRLFKKIS

SEQ ID NO: 424 - protein, 26 aa, Artificial sequence
  Synthetic
DKLLFTVTIGKWKVSVSGWRLFKKIS

SEQ ID NO: 425 - protein, 22 aa, Artificial sequence
  Synthetic
DKLLFTVTIQKVSGWRLFKKIS

SEQ ID NO: 426 - protein, 22 aa, Artificial sequence
  Synthetic
KKMLFTVTIQKVSGWRLFKKIS

SEQ ID NO: 427 - protein, 22 aa, Artificial sequence
  Synthetic
KKLLFRVTIQKVSGWRLFKKIS

SEQ ID NO: 428 - protein, 21 aa, Artificial sequence
  Synthetic
DKLLFTVTIEKVSGWRLFKKI

SEQ ID NO: 429 - protein, 25 aa, Artificial sequence
  Synthetic
DKLLFTVTIEKYKVSVSGWRLFKKI

SEQ ID NO: 430 - protein, 22 aa, Artificial sequence
  Synthetic
DRLLFTVTIERVSGWRLFKKIS

SEQ ID NO: 431 - protein, 22 aa, Artificial sequence
  Synthetic
EKLLFTVTIEKVSGWRLFKKIS

SEQ ID NO: 432 - protein, 22 aa, Artificial sequence
  Synthetic
KKLLFTVTIGKVSGWRLFKKIS

SEQ ID NO: 433 - protein, 24 aa, Artificial sequence
  Synthetic
GSMRFRVTINSWRVTGYRLFERES

SEQ ID NO: 434 - protein, 22 aa, Artificial sequence
  Synthetic
GSMKFRVTINSVTGYRLFEKES

SEQ ID NO: 435 - protein, 17 aa, Artificial sequence
  Synthetic
KKITTTGTLWNGNKIID

SEQ ID NO: 436 - protein, 29 aa, Artificial sequence
  Synthetic
ERLITPDGSMLFRVTINSVSGWRLFKKIS

SEQ ID NO: 437 - protein, 58 aa, Artificial sequence
  Synthetic
GRPYEGIAVDFGKKITTTGTLWNGNKIIDERLITPDGSMLFRVTINSVSGWRLFKKIS

SEQ ID NO: 438 - protein, 68 aa, Artificial sequence
  Synthetic
GVTPNKLNYFGRPYEGIAVDFGKKITTTGTLWNGNKIIDERLITPDGSMLFRVTINSVSGWRLFKKIS

SEQ ID NO: 439 - protein, 13 aa, Artificial sequence
  Synthetic
EKMLFRVTIGNWK

SEQ ID NO: 440 - protein, 13 aa, Artificial sequence
  Synthetic
EKMLFRVTIQNWK

SEQ ID NO: 441 - protein, 13 aa, Artificial sequence
  Synthetic
EKMLFRVTIDKWK

SEQ ID NO: 442 - protein, 13 aa, Artificial sequence
  Synthetic
EKMLFRVTIEKWK

SEQ ID NO: 443 - protein, 13 aa, Artificial sequence
  Synthetic
EKMLFRVTIERWK

SEQ ID NO: 444 - protein, 13 aa, Artificial sequence
  Synthetic
EKMLFRVTIDRWK

SEQ ID NO: 445 - protein, 13 aa, Artificial sequence
  Synthetic
KKMLFRVTIQKWK

SEQ ID NO: 446 - protein, 13 aa, Artificial sequence
  Synthetic
KKMLFRVTIGKWK

SEQ ID NO: 447 - protein, 13 aa, Artificial sequence
  Synthetic
KKMLFRVTIGRWK

SEQ ID NO: 448 - protein, 13 aa, Artificial sequence
  Synthetic
KKMLFRVTIGNWK

SEQ ID NO: 449 - protein, 13 aa, Artificial sequence
  Synthetic
KKMLFRVTIQNWK

SEQ ID NO: 450 - protein, 13 aa, Artificial sequence
  Synthetic
KKMLFRVTIDKWK

SEQ ID NO: 451 - protein, 13 aa, Artificial sequence
  Synthetic
KKMLFRVTIEKWK

SEQ ID NO: 452 - protein, 13 aa, Artificial sequence
  Synthetic
KKMLFRVTIERWK

SEQ ID NO: 453 - protein, 13 aa, Artificial sequence
  Synthetic
KKMLFRVTIDRWK

SEQ ID NO: 454 - protein, 13 aa, Artificial sequence
  Synthetic
RKMLFRVTIQKWK

SEQ ID NO: 455 - protein, 13 aa, Artificial sequence
  Synthetic
RKMLFRVTIGKWK

SEQ ID NO: 456 - protein, 13 aa, Artificial sequence
  Synthetic
RKMLFRVTIGRWK

SEQ ID NO: 457 - protein, 13 aa, Artificial sequence
  Synthetic
RKMLFRVTIGNWK

SEQ ID NO: 458 - protein, 13 aa, Artificial sequence
  Synthetic
RKMLFRVTIQNWK

SEQ ID NO: 459 - protein, 13 aa, Artificial sequence
  Synthetic
RKMLFRVTIDKWK

SEQ ID NO: 460 - protein, 13 aa, Artificial sequence
  Synthetic
RKMLFRVTIEKWK

SEQ ID NO: 461 - protein, 13 aa, Artificial sequence
  Synthetic
RKMLFRVTIERWK

SEQ ID NO: 462 - protein, 13 aa, Artificial sequence
  Synthetic
RKMLFRVTIDRWK

SEQ ID NO: 463 - protein, 13 aa, Artificial sequence
  Synthetic
EQMLFRVTINSWK

SEQ ID NO: 464 - protein, 13 aa, Artificial sequence
  Synthetic
SRMLFRVTINSWK

SEQ ID NO: 465 - protein, 13 aa, Artificial sequence
  Synthetic
GEMLFRVTINSWK

SEQ ID NO: 466 - protein, 13 aa, Artificial sequence
  Synthetic
GKMKFRVTINSWK

SEQ ID NO: 467 - protein, 13 aa, Artificial sequence
  Synthetic
GKMLFRVKINSWK

SEQ ID NO: 468 - protein, 13 aa, Artificial sequence
  Synthetic
GKMLFRVRINSWK

SEQ ID NO: 469 - protein, 13 aa, Artificial sequence
  Synthetic
GKMLFRVDINSWK

SEQ ID NO: 470 - protein, 13 aa, Artificial sequence
  Synthetic
GKMLFRVTIDSWK

SEQ ID NO: 471 - protein, 13 aa, Artificial sequence
  Synthetic
GKMLFRVTINKWK

SEQ ID NO: 472 - protein, 13 aa, Artificial sequence
  Synthetic
EKMLFKVTIQKWK

SEQ ID NO: 473 - protein, 13 aa, Artificial sequence
  Synthetic
EKMLFTVTIQKWK

SEQ ID NO: 474 - protein, 13 aa, Artificial sequence
  Synthetic
EKMLFKVTIDKWK

SEQ ID NO: 475 - protein, 13 aa, Artificial sequence
  Synthetic
EKMLFTVTIDKWK

SEQ ID NO: 476 - protein, 13 aa, Artificial sequence
  Synthetic
EKMLFKVTIGRWK

SEQ ID NO: 477 - protein, 13 aa, Artificial sequence
  Synthetic
DKMLFKVTIQKWK

SEQ ID NO: 478 - protein, 13 aa, Artificial sequence
  Synthetic
DKMLFTVTIQKWK

SEQ ID NO: 479 - protein, 13 aa, Artificial sequence
  Synthetic
DKMLFKVTIDKWK

SEQ ID NO: 480 - protein, 13 aa, Artificial sequence
  Synthetic
DKMLFTVTIDKWK

SEQ ID NO: 481 - protein, 13 aa, Artificial sequence
  Synthetic
GKMLFKVTIEKWK

SEQ ID NO: 482 - protein, 13 aa, Artificial sequence
  Synthetic
GKMLFTVTIEKWK

SEQ ID NO: 483 - protein, 13 aa, Artificial sequence
  Synthetic
DKMLFKVTIGKWK

SEQ ID NO: 484 - protein, 13 aa, Artificial sequence
  Synthetic
DKMLFTVTIGKWK

SEQ ID NO: 485 - protein, 13 aa, Artificial sequence
  Synthetic
DKMLFKVTIGNWK

SEQ ID NO: 486 - protein, 13 aa, Artificial sequence
  Synthetic
DKMLFKVTIQNWK

SEQ ID NO: 487 - protein, 13 aa, Artificial sequence
  Synthetic
GKMLFKVTINKWK

SEQ ID NO: 488 - protein, 13 aa, Artificial sequence
  Synthetic
GKMLFTVTINKWK

SEQ ID NO: 489 - protein, 13 aa, Artificial sequence
  Synthetic
DKMLFKVTIEKWK

SEQ ID NO: 490 - protein, 13 aa, Artificial sequence
  Synthetic
DKMLFTVTIEKWK

SEQ ID NO: 491 - protein, 13 aa, Artificial sequence
  Synthetic
DKLLFKVTIGKWK

SEQ ID NO: 492 - protein, 13 aa, Artificial sequence
  Synthetic
DKMLFTVTINKWK

SEQ ID NO: 493 - protein, 13 aa, Artificial sequence
  Synthetic
DKLLFTVTIQKWK

SEQ ID NO: 494 - protein, 13 aa, Artificial sequence
  Synthetic
DKLLFTVTIQKYK

SEQ ID NO: 495 - protein, 13 aa, Artificial sequence
  Synthetic
DKLLFTVTIEKWK

SEQ ID NO: 496 - protein, 13 aa, Artificial sequence
  Synthetic
DKLLFTVTIEKYK

SEQ ID NO: 497 - protein, 13 aa, Artificial sequence
  Synthetic
DKLLFTVTIGKWK

SEQ ID NO: 498 - protein, 13 aa, Artificial sequence
  Synthetic
DKLLFTVTIGKYK

SEQ ID NO: 499 - protein, 13 aa, Artificial sequence
  Synthetic
DKLLFTVTINKWK

SEQ ID NO: 500 - protein, 13 aa, Artificial sequence
  Synthetic
DKLLFTVTINKYK

SEQ ID NO: 501 - protein, 11 aa, Artificial sequence
  Synthetic
GKMLFRVTINS

SEQ ID NO: 502 - protein, 11 aa, Artificial sequence
  Synthetic
DKMLFTVTIQK

SEQ ID NO: 503 - protein, 11 aa, Artificial sequence
  Synthetic
DKMLFKVTIQK

SEQ ID NO: 504 - protein, 11 aa, Artificial sequence
  Synthetic
DKLLFTVTIGK

SEQ ID NO: 505 - protein, 11 aa, Artificial sequence
  Synthetic
DKMLFTVTIGK

SEQ ID NO: 506 - protein, 11 aa, Artificial sequence
  Synthetic
DKMLFTVTIEK

SEQ ID NO: 507 - protein, 11 aa, Artificial sequence
  Synthetic
DKLLFTVTIEK

SEQ ID NO: 508 - protein, 13 aa, Artificial sequence
  Synthetic
DKMLFRVTINSWK

SEQ ID NO: 509 - protein, 13 aa, Artificial sequence
  Synthetic
EKMLFRVTINSWK

SEQ ID NO: 510 - protein, 13 aa, Artificial sequence
  Synthetic
RKMLFRVTINSWK

SEQ ID NO: 511 - protein, 13 aa, Artificial sequence
  Synthetic
KKMLFRVTINSWK

SEQ ID NO: 512 - protein, 13 aa, Artificial sequence
  Synthetic
HKMLFRVTINSWK

SEQ ID NO: 513 - protein, 13 aa, Artificial sequence
  Synthetic
GLMLFRVTINSWK

SEQ ID NO: 514 - protein, 13 aa, Artificial sequence
  Synthetic
GQMLFRVTINSWK

SEQ ID NO: 515 - protein, 13 aa, Artificial sequence
  Synthetic
GTMLFRVTINSWK

SEQ ID NO: 516 - protein, 13 aa, Artificial sequence
  Synthetic
GKLLFRVTINSWK

SEQ ID NO: 517 - protein, 13 aa, Artificial sequence
  Synthetic
GKMLFKVTINSWK

SEQ ID NO: 518 - protein, 13 aa, Artificial sequence
  Synthetic
GKMLFRVTIQSWK

SEQ ID NO: 519 - protein, 13 aa, Artificial sequence
  Synthetic
GKMLFRVTIDSWK

SEQ ID NO: 520 - protein, 13 aa, Artificial sequence
  Synthetic
GKMLFRVTIGSWK

SEQ ID NO: 521 - protein, 13 aa, Artificial sequence
  Synthetic
GKMLFRVTINTWK

SEQ ID NO: 522 - protein, 13 aa, Artificial sequence
  Synthetic
GKMLFRVTINNWK

SEQ ID NO: 523 - protein, 13 aa, Artificial sequence
  Synthetic
GKMLFRVTINQWK

SEQ ID NO: 524 - protein, 13 aa, Artificial sequence
  Synthetic
GKMLFRVTINPWK

SEQ ID NO: 525 - protein, 13 aa, Artificial sequence
  Synthetic
GKMLFRVTINKWK

SEQ ID NO: 526 - protein, 13 aa, Artificial sequence
  Synthetic
GKMLFRVTINSWQ

SEQ ID NO: 527 - protein, 13 aa, Artificial sequence
  Synthetic
GKMLFRVTINSWN

SEQ ID NO: 528 - protein, 13 aa, Artificial sequence
  Synthetic
GKMLFRVTINSWT

SEQ ID NO: 529 - protein, 13 aa, Artificial sequence
  Synthetic
GKMLFRVTINSWH

SEQ ID NO: 530 - protein, 13 aa, Artificial sequence
  Synthetic
GKMLFRVTINSWP

SEQ ID NO: 531 - protein, 13 aa, Artificial sequence
  Synthetic
GKMLFRVTINSWR

SEQ ID NO: 532 - protein, 13 aa, Artificial sequence
  Synthetic
GKMKFRVTIDSWK

SEQ ID NO: 533 - protein, 13 aa, Artificial sequence
  Synthetic
GKMLFRVEINSWK

SEQ ID NO: 534 - protein, 13 aa, Artificial sequence
  Synthetic
GKMLFRVQINSWK

SEQ ID NO: 535 - protein, 13 aa, Artificial sequence
  Synthetic
GKMKFRVKINSWK

SEQ ID NO: 536 - protein, 13 aa, Artificial sequence
  Synthetic
GKMKFRVRINSWK

SEQ ID NO: 537 - protein, 13 aa, Artificial sequence
  Synthetic
GKMKFRVEINSWK

SEQ ID NO: 538 - protein, 13 aa, Artificial sequence
  Synthetic
GKMKFRVDINSWK

SEQ ID NO: 539 - protein, 13 aa, Artificial sequence
  Synthetic
GKMKFRVQINSWK

SEQ ID NO: 540 - protein, 13 aa, Artificial sequence
  Synthetic
GKMKFRVNINSWK

SEQ ID NO: 541 - protein, 13 aa, Artificial sequence
  Synthetic
GKMKFRVSINSWK

SEQ ID NO: 542 - protein, 13 aa, Artificial sequence
  Synthetic
GKMLFRVNINSWK

SEQ ID NO: 543 - protein, 13 aa, Artificial sequence
  Synthetic
GKMLFRVSINSWK

SEQ ID NO: 544 - protein, 13 aa, Artificial sequence
  Synthetic
GKMLFRVWINSWK

SEQ ID NO: 545 - protein, 13 aa, Artificial sequence
  Synthetic
GKMSFRVTINSWK

SEQ ID NO: 546 - protein, 13 aa, Artificial sequence
  Synthetic
GKMWFRVTINSWK

SEQ ID NO: 547 - protein, 13 aa, Artificial sequence
  Synthetic
GKMNFRVTINSWK

SEQ ID NO: 548 - protein, 13 aa, Artificial sequence
  Synthetic
GSMLFRVTINSYK

SEQ ID NO: 549 - protein, 13 aa, Artificial sequence
  Synthetic
GKMLFRVTINSYK

SEQ ID NO: 550 - protein, 13 aa, Artificial sequence
  Synthetic
GKMLFRVTIKSWK

SEQ ID NO: 551 - protein, 13 aa, Artificial sequence
  Synthetic
GKMLFRVTIESWK

SEQ ID NO: 552 - protein, 13 aa, Artificial sequence
  Synthetic
GKMKFRVTIQSWK

SEQ ID NO: 553 - protein, 13 aa, Artificial sequence
  Synthetic
GKMKFRVTIESWK

SEQ ID NO: 554 - protein, 13 aa, Artificial sequence
  Synthetic
GKMKFRVTIKSWK

SEQ ID NO: 555 - protein, 13 aa, Artificial sequence
  Synthetic
GKMKFRVTIRSWK

SEQ ID NO: 556 - protein, 13 aa, Artificial sequence
  Synthetic
RLMLFRVTINSWK

SEQ ID NO: 557 - protein, 13 aa, Artificial sequence
  Synthetic
RQMLFRVTINSWK

SEQ ID NO: 558 - protein, 13 aa, Artificial sequence
  Synthetic
KLMLFRVTINSWK

SEQ ID NO: 559 - protein, 13 aa, Artificial sequence
  Synthetic
KQMLFRVTINSWK

SEQ ID NO: 560 - protein, 13 aa, Artificial sequence
  Synthetic
ELMLFRVTINSWK

SEQ ID NO: 561 - protein, 13 aa, Artificial sequence
  Synthetic
DLMLFRVTINSWK

SEQ ID NO: 562 - protein, 13 aa, Artificial sequence
  Synthetic
DQMLFRVTINSWK

SEQ ID NO: 563 - protein, 13 aa, Artificial sequence
  Synthetic
DKMLFRVTINSWK

SEQ ID NO: 564 - protein, 13 aa, Artificial sequence
  Synthetic
EKMLFRVTINSWK

SEQ ID NO: 565 - protein, 13 aa, Artificial sequence
  Synthetic
RKMLFRVTINSWK

SEQ ID NO: 566 - protein, 13 aa, Artificial sequence
  Synthetic
KKMLFRVTINSWK

SEQ ID NO: 567 - protein, 13 aa, Artificial sequence
  Synthetic
GKMLFRVTIGSWK

SEQ ID NO: 568 - protein, 13 aa, Artificial sequence
  Synthetic
GKMLFRVTINKWK

SEQ ID NO: 569 - protein, 13 aa, Artificial sequence
  Synthetic
GKMLFRVTISKWK

SEQ ID NO: 570 - protein, 13 aa, Artificial sequence
  Synthetic
GKMLFRVTIQKWK

SEQ ID NO: 571 - protein, 13 aa, Artificial sequence
  Synthetic
GKMLFRVTITKWK

SEQ ID NO: 572 - protein, 13 aa, Artificial sequence
  Synthetic
GKMLFRVTIKKWK

SEQ ID NO: 573 - protein, 13 aa, Artificial sequence
  Synthetic
GKMLFKVTINSWK

SEQ ID NO: 574 - protein, 13 aa, Artificial sequence
  Synthetic
RLMLFRVTIGKWK

SEQ ID NO: 575 - protein, 13 aa, Artificial sequence
  Synthetic
GKMLFRVTINRWK

SEQ ID NO: 576 - protein, 13 aa, Artificial sequence
  Synthetic
EKMLFTVTIGKWK

SEQ ID NO: 577 - protein, 13 aa, Artificial sequence
  Synthetic
EKLLFTVTIGKWK

SEQ ID NO: 578 - protein, 13 aa, Artificial sequence
  Synthetic
EKMLFTVTIGRWK

SEQ ID NO: 579 - protein, 13 aa, Artificial sequence
  Synthetic
EKMLFTVTIEKWK

SEQ ID NO: 580 - protein, 13 aa, Artificial sequence
  Synthetic
DKMLFRVTIESWK

SEQ ID NO: 581 - protein, 13 aa, Artificial sequence
  Synthetic
EKLLFRVTIGKYK

SEQ ID NO: 582 - protein, 13 aa, Artificial sequence
  Synthetic
DKLLFKVTIQKWK

SEQ ID NO: 583 - protein, 13 aa, Artificial sequence
  Synthetic
DKLLFKVTIQKYK

SEQ ID NO: 584 - protein, 13 aa, Artificial sequence
  Synthetic
DKLLFKVTIGKYK

SEQ ID NO: 585 - protein, 13 aa, Artificial sequence
  Synthetic
DKLLFKVTIEKWK

SEQ ID NO: 586 - protein, 13 aa, Artificial sequence
  Synthetic
DKLLFKVTIEKYK

SEQ ID NO: 587 - protein, 13 aa, Artificial sequence
  Synthetic
KKLLFRVTIQKWK

SEQ ID NO: 588 - protein, 13 aa, Artificial sequence
  Synthetic
DRMLFRVTIQRWR

SEQ ID NO: 589 - protein, 13 aa, Artificial sequence
  Synthetic
ERMLFRVTIGRWR

SEQ ID NO: 590 - protein, 13 aa, Artificial sequence
  Synthetic
GRMLFRVTINRWR

SEQ ID NO: 591 - protein, 13 aa, Artificial sequence
  Synthetic
DRMLFRVTIERWR

SEQ ID NO: 592 - protein, 13 aa, Artificial sequence
  Synthetic
DKMLFKVTIQKYK

SEQ ID NO: 593 - protein, 13 aa, Artificial sequence
  Synthetic
DKMLFRVTINKWK

SEQ ID NO: 594 - protein, 13 aa, Artificial sequence
  Synthetic
DKMLFKVTIEKYK

SEQ ID NO: 595 - protein, 13 aa, Artificial sequence
  Synthetic
DKMLFKVTINKWK

SEQ ID NO: 596 - protein, 158 aa, Artificial sequence
  Synthetic
VFTLEDFVGDWYQTAAYNLDQVLEQGGVSSLLQNLAVSVTPIQRMVRSGENALKIDIHVIIPYEGLSADQMAQIEEVFKVVYPVDDHHFKVILPYGTLVIDGVTPNMLNYFGRPYEGIAVFDGKKITVTGTLWNGVKIIDERLITPDGSMSFRVTINS

SEQ ID NO: 597 - DNA, 474 bp, Artificial sequence
  Synthetic
gtcttcacactcgaagatttcgttggggactggcggcagacagccgcctacaacctggaccaagtccttgaacagggaggtgtgtccagtttgctgcagaatctcgccgtgtccgtaactccgatccaaaggatggtccggagcggtgaaaatgccctgaagatcgacatccatgtcatcatcccgtatgaaggtctgagcgccgaccaaatggcccagatcgaagaggtgtttaaggtggtgtaccctgtggatgatcatcactttaaggtgatcctgccctatggcacactggtaatcgacggggttacgccgaacatgctgaactatttcggacggccgtatgaaggcatcgccgtgttcgacggcaaaaagatcactgtaacagggaccctgtggaacggcgtcaaaattatcgacgagcgcctgatcacccccgacggctccatgtccttccgagtaaccatcaacagc

SEQ ID NO: 598 - protein, 158 aa, Artificial sequence
  Synthetic
VFTLEDFVGDWRQTAAYNLDQVLEQGGVSSLLQNLAVSVTPIQRMVRSGENALKIDIHVIIPYEGLSADQMAQIEEVFKVVYPVDDHHFKVILPYGTLVIDGVTPNMLNYFGRPYEGIAVFDGKKITVTGTLWNGVKIIDERLITPDGSMSFRVTINS

SEQ ID NO: 599 - DNA, 474 bp, Artificial sequence
  Synthetic
gtcttcacactcgaagatttcgttggggactggctgcagacagccgcctacaacctggaccaagtccttgaacagggaggtgtgtccagtttgctgcagaatctcgccgtgtccgtaactccgatccaaaggatggtccggagcggtgaaaatgccctgaagatcgacatccatgtcatcatcccgtatgaaggtctgagcgccgaccaaatggcccagatcgaagaggtgtttaaggtggtgtaccctgtggatgatcatcactttaaggtgatcctgccctatggcacactggtaatcgacggggttacgccgaacatgctgaactatttcggacggccgtatgaaggcatcgccgtgttcgacggcaaaaagatcactgtaacagggaccctgtggaacggcgtcaaaattatcgacgagcgcctgatcacccccgacggctccatgtccttccgagtaaccatcaacagc

SEQ ID NO: 600 - protein, 158 aa, Artificial sequence
  Synthetic
VFTLEDFVGDWLQTAAYNLDQVLEQGGVSSLLQNLAVSVTPIQRMVRSGENALKIDIHVIIPYEGLSADQMAQIEEVFKVVYPVDDHHFKVILPYGTLVIDGVTPNMLNYFGRPYEGIAVFDGKKITVTGTLWNGVKIIDERLITPDGSMSFRVTINS

SEQ ID NO: 601 - DNA, 474 bp, Artificial sequence
  Synthetic
gtcttcacactcgaagatttcgttggggactggaaccagacagccgcctacaacctggaccaagtccttgaacagggaggtgtgtccagtttgctgcagaatctcgccgtgtccgtaactccgatccaaaggatggtccggagcggtgaaaatgccctgaagatcgacatccatgtcatcatcccgtatgaaggtctgagcgccgaccaaatggcccagatcgaagaggtgtttaaggtggtgtaccctgtggatgatcatcactttaaggtgatcctgccctatggcacactggtaatcgacggggttacgccgaacatgctgaactatttcggacggccgtatgaaggcatcgccgtgttcgacggcaaaaagatcactgtaacagggaccctgtggaacggcgtcaaaattatcgacgagcgcctgatcacccccgacggctccatgtccttccaggtaaccatcaacagc

SEQ ID NO: 602 - protein, 158 aa, Artificial sequence
  Synthetic
VFTLEDFVGDWNQTAAYNLDQVLEQGGVSSLLQNLAVSVTPIQRMVRSGENALKIDIHVIIPYEGLSADQMAQIEEVFKVVYPVDDHHFKVILPYGTLVIDGVTPNMLNYFGRPYEGIAVFDGKKITVTGTLWNGVKIIDERLITPDGSMSFQVTINS

SEQ ID NO: 603 - DNA, 474 bp, Artificial sequence
  Synthetic
gtcttcacactcgaagatttcgttggggactggaaccagacagccgcctacaacctggaccaagtccttgaacagggaggtgtgtccagtttgctgcagaatctcgccgtgtccgtaactccgatccaaaggatggtccggagcggtgaaaatgccctgaagatcgacatccatgtcatcatcccgtatgaaggtctgagcgccgaccaaatggcccagatcgaagaggtgtttaaggtggtgtaccctgtggatgatcatcactttaaggtgatcctgccctatggcacactggtaatcgacggggttacgccgaacatgctgaactatttcggacggccgtatgaaggcatcgccgtgttcgacggcaaaaagatcactgtaacagggaccctgtggaacggcgtcaaaattatcgacgagcgcctgatcacccccgacggctccatgtccttccgagtaaccatcgacagc

SEQ ID NO: 604 - protein, 158 aa, Artificial sequence
  Synthetic
VFTLEDFVGDWNQTAAYNLDQVLEQGGVSSLLQNLAVSVTPIQRMVRSGENALKIDIHVIIPYEGLSADQMAQIEEVFKVVYPVDDHHFKVILPYGTLVIDGVTPNMLNYFGRPYEGIAVFDGKKITVTGTLWNGVKIIDERLITPDGSMSFRVTIDS

SEQ ID NO: 605 - DNA, 474 bp, Artificial sequence
  Synthetic
gtcttcacactcgaagatttcgttggggactggcagcagacagccgcctacaacctggaccaagtccttgaacagggaggtgtgtccagtttgctgcagaatctcgccgtgtccgtaactccgatccaaaggatggtccggagcggtgaaaatgccctgaagatcgacatccatgtcatcatcccgtatgaaggtctgagcgccgaccaaatggcccagatcgaagaggtgtttaaggtggtgtaccctgtggatgatcatcactttaaggtgatcctgccctatggcacactggtaatcgacggggttacgccgaacatgctgaactatttcggacggccgtatgaaggcatcgccgtgttcgacggcaaaaagatcactgtaacagggaccctgtggaacggcgtcaaaattatcgacgagcgcctgatcacccccgacggctccatgtccttccgagtaaccatcaacagc

SEQ ID NO: 606 - protein, 158 aa, Artificial sequence
  Synthetic
VFTLEDFVGDWQQTAAYNLDQVLEQGGVSSLLQNLAVSVTPIQRMVRSGENALKIDIHVIIPYEGLSADQMAQIEEVFKVVYPVDDHHFKVILPYGTLVIDGVTPNMLNYFGRPYEGIAVFDGKKITVTGTLWNGVKIIDERLITPDGSMSFRVTINS

SEQ ID NO: 607 - DNA, 474 bp, Artificial sequence
  Synthetic
gtcttcacactcgaagatttcgttggggactggatgcagacagccgcctacaacctggaccaagtccttgaacagggaggtgtgtccagtttgctgcagaatctcgccgtgtccgtaactccgatccaaaggatggtccggagcggtgaaaatgccctgaagatcgacatccatgtcatcatcccgtatgaaggtctgagcgccgaccaaatggcccagatcgaagaggtgtttaaggtggtgtaccctgtggatgatcatcactttaaggtgatcctgccctatggcacactggtaatcgacggggttacgccgaacatgctgaactatttcggacggccgtatgaaggcatcgccgtgttcgacggcaaaaagatcactgtaacagggaccctgtggaacggcgtcaaaattatcgacgagcgcctgatcacccccgacggctccatgtccttccgagtaaccatcaacagc

SEQ ID NO: 608 - protein, 158 aa, Artificial sequence
  Synthetic
VFTLEDFVGDWMQTAAYNLDQVLEQGGVSSLLQNLAVSVTPIQRMVRSGENALKIDIHVIIPYEGLSADQMAQIEEVFKVVYPVDDHHFKVILPYGTLVIDGVTPNMLNYFGRPYEGIAVFDGKKITVTGTLWNGVKIIDERLITPDGSMSFRVTINS

SEQ ID NO: 609 - DNA, 474 bp, Artificial sequence
  Synthetic
gtcttcacactcgaagatttcgttggggactggcaccagacagccgcctacaacctggaccaagtccttgaacagggaggtgtgtccagtttgctgcagaatctcgccgtgtccgtaactccgatccaaaggatggtccggagcggtgaaaatgccctgaagatcgacatccatgtcatcatcccgtatgaaggtctgagcgccgaccaaatggcccagatcgaagaggtgtttaaggtggtgtaccctgtggatgatcatcactttaaggtgatcctgccctatggcacactggtaatcgacggggttacgccgaacatgctgaactatttcggacggccgtatgaaggcatcgccgtgttcgacggcaaaaagatcactgtaacagggaccctgtggaacggcgtcaaaattatcgacgagcgcctgatcacccccgacggctccatgtccttccgagtaaccatcaacagc

SEQ ID NO: 610 - protein, 157 aa, Artificial sequence
  Synthetic
VFTLEDFVGDWHQTAAYNLDQVLEQGGVSSLLQNLAVSVTPIQRMVRSGENALKIDIHVIIPYEGLSADQMAQIEEVFKVVYPVDDHHFKVILPYGTLVIDGVTPNMLNYFGRPYEGIAVFDGKKITVTGTLWNGVKIIDERLITPDGSMSFRVTIN

SEQ ID NO: 611 - DNA, 474 bp, Artificial sequence
  Synthetic
gtcttcacactcgaagatttcgttggggactggttccagacagccgcctacaacctggaccaagtccttgaacagggaggtgtgtccagtttgctgcagaatctcgccgtgtccgtaactccgatccaaaggatggtccggagcggtgaaaatgccctgaagatcgacatccatgtcatcatcccgtatgaaggtctgagcgccgaccaaatggcccagatcgaagaggtgtttaaggtggtgtaccctgtggatgatcatcactttaaggtgatcctgccctatggcacactggtaatcgacggggttacgccgaacatgctgaactatttcggacggccgtatgaaggcatcgccgtgttcgacggcaaaaagatcactgtaacagggaccctgtggaacggcgtcaaaattatcgacgagcgcctgatcacccccgacggctccatgtccttccgagtaaccatcaacagc

SEQ ID NO: 612 - protein, 158 aa, Artificial sequence
  Synthetic
VFTLEDFVGDWFQTAAYNLDQVLEQGGVSSLLQNLAVSVTPIQRMVRSGENALKIDIHVIIPYEGLSADQMAQIEEVFKVVYPVDDHHFKVILPYGTLVIDGVTPNMLNYFGRPYEGIAVFDGKKITVTGTLWNGVKIIDERLITPDGSMSFRVTINS

SEQ ID NO: 613 - DNA, 474 bp, Artificial sequence
  Synthetic
gtcttcacactcgaagatttcgttggggactggtggcagacagccgcctacaacctggaccaagtccttgaacagggaggtgtgtccagtttgctgcagaatctcgccgtgtccgtaactccgatccaaaggatggtccggagcggtgaaaatgccctgaagatcgacatccatgtcatcatcccgtatgaaggtctgagcgccgaccaaatggcccagatcgaagaggtgtttaaggtggtgtaccctgtggatgatcatcactttaaggtgatcctgccctatggcacactggtaatcgacggggttacgccgaacatgctgaactatttcggacggccgtatgaaggcatcgccgtgttcgacggcaaaaagatcactgtaacagggaccctgtggaacggcgtcaaaattatcgacgagcgcctgatcacccccgacggctccatgtccttccgagtaaccatcaacagc

SEQ ID NO: 614 - protein, 158 aa, Artificial sequence
  Synthetic
VFTLEDFVGDWWQTAAYNLDQVLEQGGVSSLLQNLAVSVTPIQRMVRSGENALKIDIHVIIPYEGLSADQMAQIEEVFKVVYPVDDHHFKVILPYGTLVIDGVTPNMLNYFGRPYEGIAVFDGKKITVTGTLWNGVKIIDERLITPDGSMSFRVTINS

SEQ ID NO: 615 - DNA, 474 bp, Artificial sequence
  Synthetic
gtcttcacactcgaagatttcgttggggactggaaacagacagccgcctacaacctggaccaagtccttgaacagggaggtgtgtccagtttgctgcagaatctcgccgtgtccgtaactccgatccaaaggatggtccggagcggtgaaaatgccctgaagatcgacatccatgtcatcatcccgtatgaaggtctgagcgccgaccaaatggcccagatagaagaggtgtttaaggtggtgtaccctgtggatgatcatcactttaaggtgatcctgccctatggcacactggtaatcgacggggttacgccgaacatgctgaactatttcggacggccgtacgaaggcatcgccgtgttcgacggcaaaaagatcactgtaacagggaccctgtggaacggcgccaaaattatcgacgagcgcctgatcacccccgacggctccatgtccttccaggtaaccatcaacagc

SEQ ID NO: 616 - protein, 158 aa, Artificial sequence
  Synthetic
VFTLEDFVGDWKQTAAYNLDQVLEQGGVSSLLQNLAVSVTPIQRMVRSGENALKIDIHVIIPYEGLSADQMAQIEEVFKVVYPVDDHHFKVILPYGTLVIDGVTPNMLNYFGRPYEGIAVFDGKKITVTGTLWNGAKIIDERLITPDGSMSFQVTINS

SEQ ID NO: 617 - DNA, 474 bp, Artificial sequence
  Synthetic
gtcttcacactcgaagatttcgttggggactggaaacagacagccgcctacaacctggaccaagtccttgaacagggaggtgtgtccagtttgctgcagaatctcgccgtgtccgtaactccgatccaaaggatggtccggagcggtgaaaatgccctgaagatcgacatccatgtcatcatcccgtatgaaggtctgagcgccgaccaaatggcccagatagaagaggtgtttaaggtggtgtaccctgtggatgatcatcactttaaggtgatcctgccctatggcacactggtaatcgacggggttacgccgaacatgctgaactatttcggacggccgtacgaaggcatcgccgtgttcgacggcaaaaagatcactgtaacagggaccctgtggaacggcgccaaaattatcgacgagcgcctgatcacccccgacggctccatgtccttccaggtaaccatcgacagc

SEQ ID NO: 618 - protein, 158 aa, Artificial sequence
  Synthetic
VFTLEDFVGDWKQTAAYNLDQVLEQGGVSSLLQNLAVSVTPIQRMVRSGENALKIDIHVIIPYEGLSADQMAQIEEVFKVVYPVDDHHFKVILPYGTLVIDGVTPNMLNYFGRPYEGIAVFDGKKITVTGTLWNGAKIIDERLITPDGSMSFQVTIDS

SEQ ID NO: 619 - DNA, 474 bp, Artificial sequence
  Synthetic
gtcttcacactcgaagatttcgttggggactggaaacagacagccgcctacaacctggaccaagtccttgaacagggaggtgtgtccagtttgctgcagaatctcgccgtgtccgtaactccgatccaaaggatggtccggagcggtgaaaatgccctgaagatcgacatccatgtcatcatcccgtatgaaggtctgagcgccgaccaaatggcccagatagaagaggtgtttaaggtggtgtaccctgtggatgatcatcactttaaggtgatcctgcactatggcacactggtaatcgacggggttacgccgaacatgctgaactatttcggacggccgtacgaaggcatcgccgtgttcgacggcaaaaagatcactgtaacagggaccctgtggaacggcgccaaaattatcgacgagcgcctgatcacccccgacggctccatgtccttccgagtaaccatcaacagc

SEQ ID NO: 620 - protein, 158 aa, Artificial sequence
  Synthetic
VFTLEDFVGDWKQTAAYNLDQVLEQGGVSSLLQNLAVSVTPIQRMVRSGENALKIDIHVIIPYEGLSADQMAQIEEVFKVVYPVDDHHFKVILHYGTLVIDGVTPNMLNYFGRPYEGIAVFDGKKITVTGTLWNGAKIIDERLITPDGSMSFRVTINS

SEQ ID NO: 621 - DNA, 474 bp, Artificial sequence
  Synthetic
gtcttcacactcgaagatttcgttggggactggaaacagacagccgcctacaacctggaccaagtccttgaacagggaggtgtgtccagtttgctgcagaatctcgccgtgtccgtaactccgatccaaaggatggtccggagcggtgaaaatgccctgaagatcgacatccatgtcatcatcccgtatgaaggtctgagcgccgaccaaatggcccagatcgaagaggtgtttaaggtggtgtaccctgtggatgatcatcactttaaggtgatcctgcactatggcacactggtaatcgacggggttacgccgaacatgctgaactatttcggacggccgtatgaaggcatcgccgtgttcgacggcaaaaagatcactgtaacagggaccctgtggaacggcgtcaaaattatcgacgagcgcctgatcacccccgacggctccatgtccttccaggtaaccatcaacagc

SEQ ID NO: 622 - protein, 158 aa, Artificial sequence
  Synthetic
VFTLEDFVGDWKQTAAYNLDQVLEQGGVSSLLQNLAVSVTPIQRMVRSGENALKIDIHVIIPYEGLSADQMAQIEEVFKVVYPVDDHHFKVILHYGTLVIDGVTPNMLNYFGRPYEGIAVFDGKKITVTGTLWNGVKIIDERLITPDGSMSFQVTINS

SEQ ID NO: 623 - DNA, 474 bp, Artificial sequence
  Synthetic
gtcttcacactcgaagatttcgttggggactggaaacagacagccgcctacaacctggaccaagtccttgaacagggaggtgtgtccagtttgctgcagaatctcgccgtgtccgtaactccgatccaaaggatggtccggagcggtgaaaatgccctgaagatcgacatccatgtcatcatcccgtatgaaggtctgagcgccgaccaaatggcccagatcgaagaggtgtttaaggtggtgtaccctgtggatgatcatcactttaaggtgatcctgcactatggcacactggtaatcgacggggttacgccgaacatgctgaactatttcggacggccgtatgaaggcatcgccgtgttcgacggcaaaaagatcactgtaacagggaccctgtggaacggcgtcaaaattatcgacgagcgcctgatcacccccgacggctccatgtccttccaggtaaccatcgacagc

SEQ ID NO: 624 - protein, 158 aa, Artificial sequence
  Synthetic
VFTLEDFVGDWKQTAAYNLDQVLEQGGVSSLLQNLAVSVTPIQRMVRSGENALKIDIHVIIPYEGLSADQMAQIEEVFKVVYPVDDHHFKVILHYGTLVIDGVTPNMLNYFGRPYEGIAVFDGKKITVTGTLWNGVKIIDERLITPDGSMSFQVTIDS

SEQ ID NO: 625 - DNA, 474 bp, Artificial sequence
  Synthetic
gtcttcacactcgaagatttcgttggggactggaaacagacagccgcctacaacctggaccaagtccttgaacagggaggtgtgtccagtttgctgcagaatctcgccgtgtccgtaactccgatccaaaggatggtccggagcggtgaaaatgccctgaagatcgacatccatgtcatcatcccgtatgaaggtctgagcgccgaccaaatggcccagatagaagaggtgtttaaggtggtgtaccctgtggatgatcatcactttaaggtgatcctgcactatggcacactggtaatcgacggggttacgccgaacatgctgaactatttcggacggccgtacgaaggcatcgccgtgttcgacggcaaaaagatcactgtaacagggaccctgtggaacggcgccaaaattatcgacgagcgcctgatcacccccgacggctccatgtccttccaggtaaccatcaacagc

SEQ ID NO: 626 - protein, 158 aa, Artificial sequence
  Synthetic
VFTLEDFVGDWKQTAAYNLDQVLEQGGVSSLLQNLAVSVTPIQRMVRSGENALKIDIHVIIPYEGLSADQMAQIEEVFKVVYPVDDHHFKVILHYGTLVIDGVTPNMLNYFGRPYEGIAVFDGKKITVTGTLWNGAKIIDERLITPDGSMSFQVTINS

SEQ ID NO: 627 - DNA, 474 bp, Artificial sequence
  Synthetic
gtcttcacactcgaagatttcgttggggactggaaacagacagccgcctacaacctggaccaagtccttgaacagggaggtgtgtccagtttgctgcagaatctcgccgtgtccgtaactccgatccaaaggatggtccggagcggtgaaaatgccctgaagatcgacatccatgtcatcatcccgtatgaaggtctgagcgccgaccaaatggcccagatagaagaggtgtttaaggtggtgtaccctgtggatgatcatcactttaaggtgatcctgcactatggcacactggtaatcgacggggttacgccgaacatgctgaactatttcggacggccgtacgaaggcatcgccgtgttcgacggcaaaaagatcactgtaacagggaccctgtggaacggcggcaaaattatcgacgagcgcctgatcacccccgacggctccatgtccttccaggtaaccatcaacagc

SEQ ID NO: 628 - protein, 158 aa, Artificial sequence
  Synthetic
VFTLEDFVGDWKQTAAYNLDQVLEQGGVSSLLQNLAVSVTPIQRMVRSGENALKIDIHVIIPYEGLSADQMAQIEEVFKVVYPVDDHHFKVILHYGTLVIDGVTPNMLNYFGRPYEGIAVFDGKKITVTGTLWNGGKIIDERLITPDGSMSFQVTINS

SEQ ID NO: 629 - DNA, 470 bp, Artificial sequence
  Synthetic
ttcactttggaagatttcgtgggtgactggaaacagactgcagcatacaacttagaccaagtgttggaacagggtggagttagttcgcttttacagaatttggcagttagtgttacgcctatacaacgtatggtgagatcgggagaaaatgcattaaaaatagacatacatgtgataataccttatgaaggattatcggcagaccaaatggcacagatagaagaggtttttaaagttgtttacccagttgatgatcatcactttaaagttatattacactatggaactttagttatagacggtgtgactcctaacatgttaaactatttcggtagaccttatgaaggaatagcagttttcgacggaaagaaaataacggttactggtacgttatggaacggagccaagataatagacgagagattaataacgccagacggaagtatgagtttccaggttacgataaactc

SEQ ID NO: 630 - protein, 157 aa, Artificial sequence
  Synthetic
FTLEDFVGDWKQTAAYNLDQVLEQGGVSSLLQNLAVSVTPIQRMVRSGENALKIDIHVIIPYEGLSADQMAQIEEVFKVVYPVDDHHFKVILHYGTLVIDGVTPNMLNYFGRPYEGIAVFDGKKITVTGTLWNGAKIIDERLITPDGSMSFQVTINS

SEQ ID NO: 631 - DNA, 471 bp, Artificial sequence
  Synthetic
ttcactttggaagatttcgtgggtgactggaaacagactgcagcatacaacttagaccaagtgttggaacagggtggagttagttcgcttttacagaatttggcagttagtgttacgcctatacaacgtatggtgagatcgggagaaaatgcattaaaaatagacatacatgtgataataccttatgaaggattatcggcagaccaaatggcacagatagaagaggtttttaaagttgtttacccagttgatgatcatcactttaaagttatattacactatggaactttagttatagacggtgtgactcctaacatgttaaactatttcggtagaccttatgaaggaatagcagttttcgacggaaagaaaataacggttactggtacgttatggaacggagccaagataatagacgagagattaataacgccagacggaagtatgagtttccaggttacgatagactcg

SEQ ID NO: 632 - protein, 156 aa, Artificial sequence
  Synthetic
FTLEDFVGDWKQTAAYNLDQVLEQGGVSSLLQNLAVSVTPIQRMVRSGENALKIDIHVIIPYEGLSADQMAQIEEVFKVVYPVDDHHFKVILHYGTLVIDGVTPNMLNYFGRPYEGIAVFDGKKITVTGTLWNGAKIIDERLITPDGSMSFQVTID

SEQ ID NO: 633 - DNA, 471 bp, Artificial sequence
  Synthetic
ttcactttggacgatttcgtgggtgactggaaacagactgcagcatacaacttagaccaagtgttggaacagggtggagttagttcgcttttacagaatttggcagttagtgttacgcctatacaacgtatggtgagatcgggagaaaatgcattaaaaatagacatacatgtgataataccttatgaaggattatcggcagaccaaatggcacagatagaagaggtttttaaagttgtttacccagttgatgatcatcactttaaagttatattaccatatggaactttagttatagacggtgtgactcctaacatgttaaactatttcggtagaccttatgaaggaatagcagttttcgacggaaagaaaataacggttactggtacgttatggaacggagccaagataatagacgagagattaataacgccagacggaagtatgagtttccaggttacgataaactcg

SEQ ID NO: 634 - protein, 157 aa, Artificial sequence
  Synthetic
FTLDDFVGDWKQTAAYNLDQVLEQGGVSSLLQNLAVSVTPIQRMVRSGENALKIDIHVIIPYEGLSADQMAQIEEVFKVVYPVDDHHFKVILPYGTLVIDGVTPNMLNYFGRPYEGIAVFDGKKITVTGTLWNGAKIIDERLITPDGSMSFQVTINS

SEQ ID NO: 635 - DNA, 472 bp, Artificial sequence
  Synthetic
ttcactttggacgatttcgtgggtgactggaaacagactgcagcatacaacttagaccaagtgttggaacagggtggagttagttcgcttttacagaatttggcagttagtgttacgcctataatgcgtatggtgagatcgggagaaaatgcattaaaaatagacatacatgtgataataccttatgaaggattatcggcagaccaaatggcacagatagaagaggtttttaaagttgtttacccagttgatgatcatcactttaaagttatattacactatggaactttagttatagacggtgtgactcctaacatgttaaactatttcggtagaccttatgaaggaatagcagttttcgacggaaagaaaataacggttactggtacgttatggaacggagccaagataatagacgagagattaataacgccagacggaagtatgagtttccaggttacgataaactcgt

SEQ ID NO: 636 - protein, 157 aa, Artificial sequence
  Synthetic
FTLDDFVGDWKQTAAYNLDQVLEQGGVSSLLQNLAVSVTPIMRMVRSGENALKIDIHVIIPYEGLSADQMAQIEEVFKVVYPVDDHHFKVILHYGTLVIDGVTPNMLNYFGRPYEGIAVFDGKKITVTGTLWNGAKIIDERLITPDGSMSFQVTINS

SEQ ID NO: 637 - DNA, 471 bp, Artificial sequence
  Synthetic
ttcactttggaagatttcgtgggtgactggaaacagactgcagcattcaacttagacccagtgttggaacagggtggagttagttcgcttttacagaatttggcagttagtgttacgcctatacaacgtatggtgagatcgggagaaaatgcattaaaaatagacatacatgtgataataccttatgaaggattatcggcagaccaaatggcacagatagaagaggtttttaaagttgtttacccagttgatgatcatcactttaaagttatattacactatggaactttagttatagacggtgtgactcctaacatgttaaactatttcggtagaccttatgaaggaatagcagttttcgacggaaagaaaataacggttactggtacgctatggaacggagccaagataatagacgagagattaataacgccagacggaagtatgagtttccacgttacgataaactcg

SEQ ID NO: 638 - protein, 157 aa, Artificial sequence
  Synthetic
FTLEDFVGDWKQTAAFNLDPVLEQGGVSSLLQNLAVSVTPIQRMVRSGENALKIDIHVIIPYEGLSADQMAQIEEVFKVVYPVDDHHFKVILHYGTLVIDGVTPNMLNYFGRPYEGIAVFDGKKITVTGTLWNGAKIIDERLITPDGSMSFHVTINS

SEQ ID NO: 639 - DNA, 471 bp, Artificial sequence
  Synthetic
ttcactttggaggatttcgtgggtgactggaaacagactgcagcatacaacttagaccaagtgttggaacagggtggagttagttcgcttttacagaatttggcagttagtgttacgcctatacaacgtatggtgagatcgggagaaaatgcattaaaaatagacatacatgtgataataccttatgaaggattatcggcagaccaaatggcacagatagaagaggtttttaaagttgtttacccagttgatgatcatcactttaaagttatattacactatggaactttagttatagacggtgtgactcctaacaggttaaactatttcggtagaccttttgaaggaatagcagttttcgacggaaagaaaataacggttactggtacgttatggaacggagccaagataatagacgagagattaataacgccagacggaagtatgagtttccaggttacgataaactcg

SEQ ID NO: 640 - protein, 157 aa, Artificial sequence
  Synthetic
FTLEDFVGDWKQTAAYNLDQVLEQGGVSSLLQNLAVSVTPIQRMVRSGENALKIDIHVIIPYEGLSADQMAQIEEVFKVVYPVDDHHFKVILHYGTLVIDGVTPNRLNYFGRPFEGIAVFDGKKITVTGTLWNGAKIIDERLITPDGSMSFQVTINS

SEQ ID NO: 641 - DNA, 471 bp, Artificial sequence
  Synthetic
ttcactttggaagatttcgtgggtgactggaaacagactgcagcatacaacttagaccaagtgttggaacagggtggagttagttcgcttttacagaatttggcagttagtgttacgcctatacaacgtgtggtgagatcgggagaaaatgcattaaaaatagacatacatgtgataataccttatgaaggattatcggcagaccaaatggcacagatagaagaggtttttaaagttgtttacccagttgatgatcatcactttaaagttatattacactatggaactttagttatagacggtgtgactcctaacatgttaaactatttcggtagaccttatgaaggaatagcagttttcgacggaaagaaaataacggttacaggtacgttatggaacggagccaagataatagacgagagattaataacgccagacggaagtatgagtttccaggttacgataaactcg

SEQ ID NO: 642 - protein, 157 aa, Artificial sequence
  Synthetic
FTLEDFVGDWKQTAAYNLDQVLEQGGVSSLLQNLAVSVTPIQRVVRSGENALKIDIHVIIPYEGLSADQMAQIEEVFKVVYPVDDHHFKVILHYGTLVIDGVTPNMLNYFGRPYEGIAVFDGKKITVTGTLWNGAKIIDERLITPDGSMSFQVTINS

SEQ ID NO: 643 - DNA, 471 bp, Artificial sequence
  Synthetic
ttcactttggaagatttcgtgggtgactggaaacagactgcagcatacaacttagaccaagtgttggaacagggtggagttagttcgcttttacagaatttggcagttagtgttacgcctatacaacgtatagtgagatcgggagaaaatgcattaaaaatagacatacatgtgataataccttatgaaggattatcggcagaccaaatggcacagatagaagaggtttttaaagttgtttacccagttgatgatcatcactttaaagttatattacactatggaactttagttatagacggtgtgactcctaacatgttaaactatttcggtagaccttatgaaggaatagcagttttcgacggaaagaaaataacggttactggtacgttatggaacggagccaagataatagacgagagattaataacgccagacggaagtatgagtttccaggttacgataaactcg

SEQ ID NO: 644 - protein, 157 aa, Artificial sequence
  Synthetic
FTLEDFVGDWKQTAAYNLDQVLEQGGVSSLLQNLAVSVTPIQRIVRSGENALKIDIHVIIPYEGLSADQMAQIEEVFKVVYPVDDHHFKVILHYGTLVIDGVTPNMLNYFGRPYEGIAVFDGKKITVTGTLWNGAKIIDERLITPDGSMSFQVTINS

SEQ ID NO: 645 - DNA, 471 bp, Artificial sequence
  Synthetic
ttcactttggaagatttcgtgggtgactggaaacagactgcagcatacaacttagaccaagtgttggaacagggtggagttagttcgcttttacagaatttggctgttagtgttacgccaatacaacgtatggtgagatcgggagaaaatgcattaaaaatagacatacatgtgataataccttatgaaggattatcggcagaccaaatggcacagatagaagaggtttttaaagttgtttacccagttgatgatcatcactttaaagttatattacactatggaactttagttatagacggtgtgactcctaacaggttaaactatttcggtagaccttatgaaggaatagcagttttcgacggaaagaaaataacggttactggtacgttatggaacggagccaagataatagacgagagattaataacgccagacggaagtatgagtttccaggttacgataaactcg

SEQ ID NO: 646 - protein, 157 aa, Artificial sequence
  Synthetic
FTLEDFVGDWKQTAAYNLDQVLEQGGVSSLLQNLAVSVTPIQRMVRSGENALKIDIHVIIPYEGLSADQMAQIEEVFKVVYPVDDHHFKVILHYGTLVIDGVTPNRLNYFGRPYEGIAVFDGKKITVTGTLWNGAKIIDERLITPDGSMSFQVTINS

SEQ ID NO: 647 - DNA, 471 bp, Artificial sequence
  Synthetic
ttcactttggaagatttcgtgggtgactggaaacagactgcagcatacaacttagaccaagtgttggaacagggtggagttagttcgcttttacagaatttggcagttagtgttacgcctatacaacgtatggtgagatcgggagaaaatgcattaaaaatagacatacatgtgataataccttatgaaggattatcggcagaccaaatggcacagatagaagaggtttttaaagttgtttacccagttgatgatcatcactttaaagttatattacactatggaactttagttatagacggtgtgactcctaacacgttaaactatttcggtagaccttatgaaggaatagcagttttcgacggaaagaaaataacggttactggtacgttatggaacggagccaagataatagacgagagattaataacgccagacggaagtatgagtttccaggttacgataaactcg

SEQ ID NO: 648 - protein, 157 aa, Artificial sequence
  Synthetic
FTLEDFVGDWKQTAAYNLDQVLEQGGVSSLLQNLAVSVTPIQRMVRSGENALKIDIHVIIPYEGLSADQMAQIEEVFKVVYPVDDHHFKVILHYGTLVIDGVTPNTLNYFGRPYEGIAVFDGKKITVTGTLWNGAKIIDERLITPDGSMSFQVTINS

SEQ ID NO: 649 - DNA, 471 bp, Artificial sequence
  Synthetic
ttcactttggaagatttcgtgggtgactggaaacagactgcagcatacaacttagaccaagtgttggaacagggtggagttagttcgctgttacagaatttggcagttagtgttacgcctatacaacgtatggtgagatcgggagaaaatgcattaaaaatagacatacatgtgataataccttatgaaggattatcggcagaccaaatggcacagatagaagaggtttttaaagttgtttacccagttgatgatcatcactttaaagttatattacactatggaactttagttatagacggtgtgactcctaacaagttaaactatttcggtagaccttatgaaggaatagcagttttcgacggaaagaaaataacggttactggtacgttatggaacggagccgagataatagacgagagattaataacgccagacggaagtatgagtttccaggttacgataaactcg

SEQ ID NO: 650 - protein, 157 aa, Artificial sequence
  Synthetic
FTLEDFVGDWKQTAAYNLDQVLEQGGVSSLLQNLAVSVTPIQRMVRSGENALKIDIHVIIPYEGLSADQMAQIEEVFKVVYPVDDHHFKVILHYGTLVIDGVTPNKLNYFGRPYEGIAVFDGKKITVTGTLWNGAEIIDERLITPDGSMSFQVTINS

SEQ ID NO: 651 - DNA, 471 bp, Artificial sequence
  Synthetic
ttcactttggaagatttcgtgggtgactggaaacagactgcggcatacaacttagaccaagtgttggaacagggtggagttagttcgcttttacagaatttggcaggtagtgttacgcctatacaacgtatggtgagatcgggagaaaacgcattaaaaatagacatacatgtgataataccttatgaaggattatcggcagaccaaatggcacagatagaagaggtttttaaagttgtttacccagttgatgatcatcactttaaagttatattacactatggaactttagttatagacggtgtgactcctaacatgttaaactatttcggtagaccttatgaaggaatagcagttttcgacggaaagaaaataacggttactggtacgttatggaacggagccaagataatagacgagagattaataacgccagacggaagtatgagtttccaggttacgataaactcg

SEQ ID NO: 652 - protein, 157 aa, Artificial sequence
  Synthetic
FTLEDFVGDWKQTAAYNLDQVLEQGGVSSLLQNLAGSVTPIQRMVRSGENALKIDIHVIIPYEGLSADQMAQIEEVFKVVYPVDDHHFKVILHYGTLVIDGVTPNMLNYFGRPYEGIAVFDGKKITVTGTLWNGAKIIDERLITPDGSMSFQVTINS

SEQ ID NO: 653 - DNA, 471 bp, Artificial sequence
  Synthetic
ttcactttggaagatttcgtgggtgactggaaacagactgcagcgtacaacttagaccaagtgttggaacagggtggagttagttcgcttttacagaatttggcagttagtgttacgcctatacaacgtatggtgagatcgggagaaaatgcattaaaaatagacatacatgtgataataccttatgaaggattatcggctgaccaaatggcacagatagaagaggtttttaaagttgtttacccagttgatgatcatcactttaaagttatattacactatggaactttagttatagacggtgtgactcctaacttgttgaactatttcggtagaccttatgaaggaatagcagttttcgacggaaagaaaataacggttactggtacgttatggaacggagccaagataaaagacgagagattaataacgccagacggaagtatgagtttccaggttacgataaactcg

SEQ ID NO: 654 - protein, 157 aa, Artificial sequence
  Synthetic
FTLEDFVGDWKQTAAYNLDQVLEQGGVSSLLQNLAVSVTPIQRMVRSGENALKIDIHVIIPYEGLSADQMAQIEEVFKVVYPVDDHHFKVILHYGTLVIDGVTPNLLNYFGRPYEGIAVFDGKKITVTGTLWNGAKIKDERLITPDGSMSFQVTINS

SEQ ID NO: 655 - DNA, 471 bp, Artificial sequence
  Synthetic
ttcactttggaaggtttcgtgggtgactggaaacagactgcagcatacaacttagaccaagtgttggaacagggtggagttagttcgcttttacagaatttgacagttagtgttacgcctatacaacgtatggtgagatcgggagaaaatgcattaaaaatagacatacatgtgataataccttatgaaggattatcggcagaccaaatggcacagatagaagaggtttttaaagttgtttacccagttgatgatcatcactttaaagttatatttcactatggaactttagttatagtcggtgtgactcctaacatgttaaactatttcggtagaccttatgaaggaatagcagttttcgacggaaagaaaataacggttactggtacgttatggaacggagccaagataatagacgagggatcaataacgccagacggaagtatgagtttccaggttacgataaactcg

SEQ ID NO: 656 - protein, 157 aa, Artificial sequence
  Synthetic
FTLEGFVGDWKQTAAYNLDQVLEQGGVSSLLQNLTVSVTPIQRMVRSGENALKIDIHVIIPYEGLSADQMAQIEEVFKVVYPVDDHHFKVIFHYGTLVIVGVTPNMLNYFGRPYEGIAVFDGKKITVTGTLWNGAKIIDEGSITPDGSMSFQVTINS

SEQ ID NO: 657 - DNA, 471 bp, Artificial sequence
  Synthetic
ttcactttggaagatttcgtgggtgactggaaacagactgcagcatacaacttagaccaagtgttggaacagggtggagttagttcgcttttacagaatttggcagttagtgttacgcctatacaacgtaaggtgagatcgggagaaaatgcattaaaaatagacatacatgtgataataccttatgaaggattatcggcagaccaaatggcacagatagaagaggtttttaaagttgtttacccagttgatgatcatcactttaaagttatattacactatggaactttagttatagacggtgtgactcctaacatgttaaactatttcggtagaccttatgaaggaatagcagttttcgacggaaagaaaataacggttactggtacgttatggaacggagccaagataatagacgagagattaataacgccagacggaagtatgagtttccaggttacgataaactcg

SEQ ID NO: 658 - protein, 157 aa, Artificial sequence
  Synthetic
FTLEDFVGDWKQTAAYNLDQVLEQGGVSSLLQNLAVSVTPIQRKVRSGENALKIDIHVIIPYEGLSADQMAQIEEVFKVVYPVDDHHFKVILHYGTLVIDGVTPNMLNYFGRPYEGIAVFDGKKITVTGTLWNGAKIIDERLITPDGSMSFQVTINS

SEQ ID NO: 659 - DNA, 471 bp, Artificial sequence
  Synthetic
ttcactttggaagatttcgtgggtgactggaaacagactgcagcatacaacttagaccaagtgttggaacagggtggagttagttcgcttttacagaatttggcagttagtgttacgcctatacaacgtgaggtgagatcgggagaaaatgcattaaaaatagacatacatgtgataataccttatgaaggattatcggcagaccaaatggcacagatagaagaggtttttaaagttgtttacccagttgatgatcatcactttaaagttatattacactatggaactttagttatagacggtgtgactcctaacatgttaaactatttcggtagaccttatgaaggaatagcagttttcgacggaaagaaaataacggttactggtacgttatggaacggagccaagataatagacgagagattaataacgccagacggaagtatgagtttccaggttacgataaactcg

SEQ ID NO: 660 - protein, 157 aa, Artificial sequence
  Synthetic
FTLEDFVGDWKQTAAYNLDQVLEQGGVSSLLQNLAVSVTPIQREVRSGENALKIDIHVIIPYEGLSADQMAQIEEVFKVVYPVDDHHFKVILHYGTLVIDGVTPNMLNYFGRPYEGIAVFDGKKITVTGTLWNGAKIIDERLITPDGSMSFQVTINS

SEQ ID NO: 661 - DNA, 471 bp, Artificial sequence
  Synthetic
ttcactttggaagatttcgtgggtgactggaaacagactgcagcatacaacttagaccaagtgttggaacagggtggagttagttcgcttttacagaatttggcagttagtgttacgcctatacaacgtgcggtgagatcgggagaaaatgcattaaaaatagacatacatgtgataataccttatgaaggattatcggcagaccaaatggcacagatagaagaggtttttaaagttgtttacccagttgatgatcatcactttaaagttatattacactatggaactttagttatagacggtgtgactcctaacatgttaaactatttcggtagaccttatgaaggaatagcagttttcgacggaaagaaaataacggttactggtacgttatggaacggagccaagataatagacgagagattaataacgccagacggaagtatgagtttccaggttacgataaactcg

SEQ ID NO: 662 - protein, 157 aa, Artificial sequence
  Synthetic
FTLEDFVGDWKQTAAYNLDQVLEQGGVSSLLQNLAVSVTPIQRAVRSGENALKIDIHVIIPYEGLSADQMAQIEEVFKVVYPVDDHHFKVILHYGTLVIDGVTPNMLNYFGRPYEGIAVFDGKKITVTGTLWNGAKIIDERLITPDGSMSFQVTINS

SEQ ID NO: 663 - DNA, 471 bp, Artificial sequence
  Synthetic
ttcactttggaagatttcgtgggtgactggaaacagactgcagcatacaacttagaccaagtgttggaacagggtggagttagttcgcttttacagaatttggcagttagtgttacgcctatacaacgttgtgtgagatcgggagaaaatgcattaaaaatagacatacatgtgataataccttatgaaggattatcggcagaccaaatggcacagatagaagaggtttttaaagttgtttacccagttgatgatcatcactttaaagttatattacactatggaactttagttatagacggtgtgactcctaacatgttaaactatttcggtagaccttatgaaggaatagcagttttcgacggaaagaaaataacggttactggtacgttatggaacggagccaagataatagacgagagattaataacgccagacggaagtatgagtttccaggttacgataaactcg

SEQ ID NO: 664 - protein, 157 aa, Artificial sequence
  Synthetic
FTLEDFVGDWKQTAAYNLDQVLEQGGVSSLLQNLAVSVTPIQRCVRSGENALKIDIHVIIPYEGLSADQMAQIEEVFKVVYPVDDHHFKVILHYGTLVIDGVTPNMLNYFGRPYEGIAVFDGKKITVTGTLWNGAKIIDERLITPDGSMSFQVTINS

SEQ ID NO: 665 - DNA, 472 bp, Artificial sequence
  Synthetic
ttcactttggaagatttcgtgggtgactggaaacagactgcagcatacaacttagaccaagtgttggaacagggtggagttagttcgcttttacagaatttggcagttagtgttacgcctatacaacgttgggtgagatcgggagaaaatgcattaaaaatagacatacatgtgataataccttatgaaggattatcggcagaccaaatggcacagatagaagaggtttttaaagttgtttacccagttgatgatcatcactttaaagttatattacactatggaactttagttatagacggtgtgactcctaacatgttaaactatttcggtagaccttatgaaggaatagcagttttcgacggaaagaaaataacggttactggtacgttatggaacggagccaagataatagacgagagattaataacgccagacggaagtatgagtttccaggttacgataaactcgt

SEQ ID NO: 666 - protein, 157 aa, Artificial sequence
  Synthetic
FTLEDFVGDWKQTAAYNLDQVLEQGGVSSLLQNLAVSVTPIQRWVRSGENALKIDIHVIIPYEGLSADQMAQIEEVFKVVYPVDDHHFKVILHYGTLVIDGVTPNMLNYFGRPYEGIAVFDGKKITVTGTLWNGAKIIDERLITPDGSMSFQVTINS

SEQ ID NO: 667 - DNA, 471 bp, Artificial sequence
  Synthetic
ttcactttggaagatttcgtgggtgactggaaacagactgcagcatacaacttagaccaagtgttggaacagggtggagttagttcgcttttacagaatttggcagttagtgttacgcctatacaacgtggggtgagatcgggagaaaatgcattaaaaatagacatacatgtgataataccttatgaaggattatcggcagaccaaatggcacagatagaagaggtttttaaagttgtttacccagttgatgatcatcactttaaagttatattacactatggaactttagttatagacggtgtgactcctaacatgttaaactatttcggtagaccttatgaaggaatagcagttttcgacggaaagaaaataacggttactggtacgttatggaacggagccaagataatagacgagagattaataacgccagacggaagtatgagtttccaggttacgataaactcg

SEQ ID NO: 668 - protein, 157 aa, Artificial sequence
  Synthetic
FTLEDFVGDWKQTAAYNLDQVLEQGGVSSLLQNLAVSVTPIQRGVRSGENALKIDIHVIIPYEGLSADQMAQIEEVFKVVYPVDDHHFKVILHYGTLVIDGVTPNMLNYFGRPYEGIAVFDGKKITVTGTLWNGAKIIDERLITPDGSMSFQVTINS

SEQ ID NO: 669 - DNA, 471 bp, Artificial sequence
  Synthetic
ttcactttggaagatttcgtgggtgactggaaacagactgcagcatacaacttagaccaagtgttggaacagggtggagttagttcgcttttacagaatttggcagttagtgttacgcctatacaacgtcatgtgagatcgggagaaaatgcattaaaaatagacatacatgtgataataccttatgaaggattatcggcagaccaaatggcacagatagaagaggtttttaaagttgtttacccagttgatgatcatcactttaaagttatattacactatggaactttagttatagacggtgtgactcctaacatgttaaactatttcggtagaccttatgaaggaatagcagttttcgacggaaagaaaataacggttactggtacgttatggaacggagccaagataatagacgagagattaataacgccagacggaagtatgagtttccaggttacgataaactcg

SEQ ID NO: 670 - protein, 157 aa, Artificial sequence
  Synthetic
FTLEDFVGDWKQTAAYNLDQVLEQGGVSSLLQNLAVSVTPIQRHVRSGENALKIDIHVIIPYEGLSADQMAQIEEVFKVVYPVDDHHFKVILHYGTLVIDGVTPNMLNYFGRPYEGIAVFDGKKITVTGTLWNGAKIIDERLITPDGSMSFQVTINS

SEQ ID NO: 671 - DNA, 471 bp, Artificial sequence
  Synthetic
ttcactttggaagatttcgtgggtgactggaaacagactgcagcatacaacttagaccaagtgttggaacagggtggagttagttcgcttttacagaatttggcagttagtgttacgcctatacaacgtagtgtgagatcgggagaaaatgcattaaaaatagacatacatgtgataataccttatgaaggattatcggcagaccaaatggcacagatagaagaggtttttaaagttgtttacccagttgatgatcatcactttaaagttatattacactatggaactttagttatagacggtgtgactcctaacatgttaaactatttcggtagaccttatgaaggaatagcagttttcgacggaaagaaaataacggttactggtacgttatggaacggagccaagataatagacgagagattaataacgccagacggaagtatgagtttccaggttacgataaactcg

SEQ ID NO: 672 - protein, 157 aa, Artificial sequence
  Synthetic
FTLEDFVGDWKQTAAYNLDQVLEQGGVSSLLQNLAVSVTPIQRSVRSGENALKIDIHVIIPYEGLSADQMAQIEEVFKVVYPVDDHHFKVILHYGTLVIDGVTPNMLNYFGRPYEGIAVFDGKKITVTGTLWNGAKIIDERLITPDGSMSFQVTINS

SEQ ID NO: 673 - DNA, 471 bp, Artificial sequence
  Synthetic
ttcactttggaagatttcgtgggtgactggaaacagactgcagcatacaacttagaccaagtgttggaacagggtggagttagttcgcttttacagaatttggcagttagtgttacgcctatacaacgtcaggtgagatcgggagaaaatgcattaaaaatagacatacatgtgataataccttatgaaggattatcggcagaccaaatggcacagatagaagaggtttttaaagttgtttacccagttgatgatcatcactttaaagttatattacactatggaactttagttatagacggtgtgactcctaacatgttaaactatttcggtagaccttatgaaggaatagcagttttcgacggaaagaaaataacggttactggtacgttatggaacggagccaagataatagacgagagattaataacgccagacggaagtatgagtttccaggttacgataaactcg

SEQ ID NO: 674 - protein, 157 aa, Artificial sequence
  Synthetic
FTLEDFVGDWKQTAAYNLDQVLEQGGVSSLLQNLAVSVTPIQRQVRSGENALKIDIHVIIPYEGLSADQMAQIEEVFKVVYPVDDHHFKVILHYGTLVIDGVTPNMLNYFGRPYEGIAVFDGKKITVTGTLWNGAKIIDERLITPDGSMSFQVTINS

SEQ ID NO: 675 - DNA, 471 bp, Artificial sequence
  Synthetic
ttcactttggaagatttcgtgggtgactggaaacagactgcagcatacaacttagaccaagtgttggaacagggtggagttagttcgcttttacagaatttggcagttagtgttacgcctatacaacgtcgggtgagatcgggagaaaatgcattaaaaatagacatacatgtgataataccttatgaaggattatcggcagaccaaatggcacagatagaagaggtttttaaagttgtttacccagttgatgatcatcactttaaagttatattacactatggaactttagttatagacggtgtgactcctaacatgttaaactatttcggtagaccttatgaaggaatagcagttttcgacggaaagaaaataacggttactggtacgttatggaacggagccaagataatagacgagagattaataacgccagacggaagtatgagtttccaggttacgataaactcg

SEQ ID NO: 676 - protein, 157 aa, Artificial sequence
  Synthetic
FTLEDFVGDWKQTAAYNLDQVLEQGGVSSLLQNLAVSVTPIQRRVRSGENALKIDIHVIIPYEGLSADQMAQIEEVFKVVYPVDDHHFKVILHYGTLVIDGVTPNMLNYFGRPYEGIAVFDGKKITVTGTLWNGAKIIDERLITPDGSMSFQVTINS

SEQ ID NO: 677 - DNA, 471 bp, Artificial sequence
  Synthetic
ttcactttggaagatttcgtgggtgactggaaacagactgcagcatacaacttagaccaagtgttggaacagggtggagttagttcgcttttacagaatttggcagttagtgttacgcctatacaacgtacggtgagatcgggagaaaatgcattaaaaatagacatacatgtgataataccttatgaaggattatcggcagaccaaatggcacagatagaagaggtttttaaagttgtttacccagttgatgatcatcactttaaagttatattacactatggaactttagttatagacggtgtgactcctaacatgttaaactatttcggtagaccttatgaaggaatagcagttttcgacggaaagaaaataacggttactggtacgttatggaacggagccaagataatagacgagagattaataacgccagacggaagtatgagtttccaggttacgataaactcg

SEQ ID NO: 678 - protein, 157 aa, Artificial sequence
  Synthetic
FTLEDFVGDWKQTAAYNLDQVLEQGGVSSLLQNLAVSVTPIQRTVRSGENALKIDIHVIIPYEGLSADQMAQIEEVFKVVYPVDDHHFKVILHYGTLVIDGVTPNMLNYFGRPYEGIAVFDGKKITVTGTLWNGAKIIDERLITPDGSMSFQVTINS

SEQ ID NO: 679 - DNA, 471 bp, Artificial sequence
  Synthetic
ttcactttggaagatttcgtgggtgactggaaacagactgcagcatacaacttagaccaagtgttggaacagggtggagttagttcgcttttacagaatttggcagttagtgttacgcctatacaacgttatgtgagatcgggagaaaatgcattaaaaatagacatacatgtgataataccttatgaaggattatcggcagaccaaatggcacagatagaagaggtttttaaagttgtttacccagttgatgatcatcactttaaagttatattacactatggaactttagttatagacggtgtgactcctaacatgttaaactatttcggtagaccttatgaaggaatagcagttttcgacggaaagaaaataacggttactggtacgttatggaacggagccaagataatagacgagagattaataacgccagacggaagtatgagtttccaggttacgataaactcg

SEQ ID NO: 680 - protein, 157 aa, Artificial sequence
  Synthetic
FTLEDFVGDWKQTAAYNLDQVLEQGGVSSLLQNLAVSVTPIQRYVRSGENALKIDIHVIIPYEGLSADQMAQIEEVFKVVYPVDDHHFKVILHYGTLVIDGVTPNMLNYFGRPYEGIAVFDGKKITVTGTLWNGAKIIDERLITPDGSMSFQVTINS

SEQ ID NO: 681 - DNA, 471 bp, Artificial sequence
  Synthetic
ttcactttggaagatttcgtgggtgactggaaacagactgcagcatacaacttagaccaagtgttggaacagggtggagttagttcgcttttacagaatttggcagttagtgttacgcctatacaacgtctggtgagatcgggagaaaatgcattaaaaatagacatacatgtgataataccttatgaaggattatcggcagaccaaatggcacagatagaagaggtttttaaagttgtttacccagttgatgatcatcactttaaagttatattacactatggaactttagttatagacggtgtgactcctaacatgttaaactatttcggtagaccttatgaaggaatagcagttttcgacggaaagaaaataacggttactggtacgttatggaacggagccaagataatagacgagagattaataacgccagacggaagtatgagtttccaggttacgataaactcg

SEQ ID NO: 682 - protein, 157 aa, Artificial sequence
  Synthetic
FTLEDFVGDWKQTAAYNLDQVLEQGGVSSLLQNLAVSVTPIQRLVRSGENALKIDIHVIIPYEGLSADQMAQIEEVFKVVYPVDDHHFKVILHYGTLVIDGVTPNMLNYFGRPYEGIAVFDGKKITVTGTLWNGAKIIDERLITPDGSMSFQVTINS

SEQ ID NO: 683 - DNA, 471 bp, Artificial sequence
  Synthetic
ttcactttggaagatttcgtgggtgactggaaacagactgcagcatacaacttagaccaagtgttggaacagggtggagttagttcgcttttacagaatttggcagttagtgttacgcctatacaacgtcctgtgagatcgggagaaaatgcattaaaaatagacatacatgtgataataccttatgaaggattatcggcagaccaaatggcacagatagaagaggtttttaaagttgtttacccagttgatgatcatcactttaaagttatattacactatggaactttagttatagacggtgtgactcctaacatgttaaactatttcggtagaccttatgaaggaatagcagttttcgacggaaagaaaataacggttactggtacgttatggaacggagccaagataatagacgagagattaataacgccagacggaagtatgagtttccaggttacgataaactcg

SEQ ID NO: 684 - protein, 157 aa, Artificial sequence
  Synthetic
FTLEDFVGDWKQTAAYNLDQVLEQGGVSSLLQNLAVSVTPIQRPVRSGENALKIDIHVIIPYEGLSADQMAQIEEVFKVVYPVDDHHFKVILHYGTLVIDGVTPNMLNYFGRPYEGIAVFDGKKITVTGTLWNGAKIIDERLITPDGSMSFQVTINS

SEQ ID NO: 685 - DNA, 471 bp, Artificial sequence
  Synthetic
ttcactttggaagatttcgtgggtgactggaaacagactgcagcatacaacttagaccaagtgttggaacagggtggagttagttcgcttttacagaatttggcagttagtgttacgcctatacaacgttttgtgagatcgggagaaaatgcattaaaaatagacatacatgtgataataccttatgaaggattatcggcagaccaaatggcacagatagaagaggtttttaaagttgtttacccagttgatgatcatcactttaaagttatattacactatggaactttagttatagacggtgtgactcctaacatgttaaactatttcggtagaccttatgaaggaatagcagttttcgacggaaagaaaataacggttactggtacgttatggaacggagccaagataatagacgagagattaataacgccagacggaagtatgagtttccaggttacgataaactcg

SEQ ID NO: 686 - protein, 157 aa, Artificial sequence
  Synthetic
FTLEDFVGDWKQTAAYNLDQVLEQGGVSSLLQNLAVSVTPIQRFVRSGENALKIDIHVIIPYEGLSADQMAQIEEVFKVVYPVDDHHFKVILHYGTLVIDGVTPNMLNYFGRPYEGIAVFDGKKITVTGTLWNGAKIIDERLITPDGSMSFQVTINS

SEQ ID NO: 687 - DNA, 543 bp, Artificial sequence
  Synthetic
atgaaacatcaccatcaccatcatgcgatcgccatggtcttcacactcgacgatttcgttggggactgggaacagacagccgcctacaacctggaccaagtccttgaacagggaggtgtgtccagtttgctgcagaatctcgccgtgtccgtaactccgatccaaaggattgtccggagcggtgaaaatgccctgaagatcgacatccatgtcatcatcccgtatgaaggtctgagcgccgaccaaatggcccagatcgaagaggtgtttaaggtggtgtaccctgtggatgatcatcactttaaggtgatcctgccctatggcacactggtaatcgacggggttacgccgaacatgctgaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacggcgttagcggctggcgcctgttcaagaagatcagc

SEQ ID NO: 688 - protein, 181 aa, Artificial sequence
  Synthetic
MKHHHHHHAIAMVFTLDDFVGDWEQTAAYNLDQVLEQGGVSSLLQNLAVSVTPIQRIVRSGENALKIDIHVIIPYEGLSADQMAQIEEVFKVVYPVDDHHFKVILPYGTLVIDGVTPNMLNYFGRPYEGIAVFDGKKITVTGTLWNGNKIIDERLITPDGSMLFRVTINGVSGWRLFKKIS

SEQ ID NO: 689 - DNA, 543 bp, Artificial sequence
  Synthetic
atgaaacatcaccatcaccatcatgcgatcgccatggtcttcacactcgaagatttcgttggggactgggaacagacagccgcctacaacctggaccaagtccttgaacagggaggtgtgtccagtttgctgcagaatctcgccgtgtccgtaactccgatccaaaggattgtccggagcggtgaaaatgccctgaagatcgacatccatgtcatcatcccgtatgaaggtctgagcgccgaccaaatggcccagatcgaagaggtgtttaaggtggtgtaccctgtggatgatcatcactttaaggtgatcctgccctatggcacactggtaatcgacggggttacgccgaacatgctgaactatttcggacggccgtatgaaggcatcgccgtgttcgacggcaaaaagatcactgtaacagggaccctgtggaacggcaacaaaattatcgacgagcgcctgatcacccccgacaagtccatgctgttccgagtaaccatcaacggcgttagcggctggcgcctgttcaagaagatcagc

SEQ ID NO: 690 - protein, 181 aa, Artificial sequence
  Synthetic
MKHHHHHHAIAMVFTLEDFVGDWEQTAAYNLDQVLEQGGVSSLLQNLAVSVTPIQRIVRSGENALKIDIHVIIPYEGLSADQMAQIEEVFKVVYPVDDHHFKVILPYGTLVIDGVTPNMLNYFGRPYEGIAVFDGKKITVTGTLWNGNKIIDERLITPDKSMLFRVTINGVSGWRLFKKIS

SEQ ID NO: 691 - DNA, 543 bp, Artificial sequence
  Synthetic
atgaaacatcaccatcaccatcatgcgatcgccatggtcttcacactcgaagatttcgttggggactgggaacagacagccgcctacaacctggaccaagtccttgaacagggaggtgtgtccagtttgctgcagaatctcgccgtgtccgtaactccgatccaaaggattgtccggagcggtgaaaatgccctgaagatcgacatccatgtcatcatcccgtatgaaggtctgagcgccgaccaaatggcccagatcgaagaggtgtttaaggtggtgtaccctgtggatgatcatcactttaaggtgatcctgccctatggcacactggtaatcgacggggttacgccgaacatgctgaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacaaggttagcggctggcgcctgttcaagaagatcagc

SEQ ID NO: 692 - protein, 181 aa, Artificial sequence
  Synthetic
MKHHHHHHAIAMVFTLEDFVGDWEQTAAYNLDQVLEQGGVSSLLQNLAVSVTPIQRIVRSGENALKIDIHVIIPYEGLSADQMAQIEEVFKVVYPVDDHHFKVILPYGTLVIDGVTPNMLNYFGRPYEGIAVFDGKKITVTGTLWNGNKIIDERLITPDGSMLFRVTINKVSGWRLFKKIS

SEQ ID NO: 693 - DNA, 543 bp, Artificial sequence
  Synthetic
atgaaacatcaccatcaccatcatgcgatcgccatggtcttcacactcgaagatttcgttggggactgggaacagacagccgcctacaacctggaccaagtccttgaacagggaggtgtgtccagtttgctgcagaatctcgccgtgtccgtaactccgatccaaaggattgtccggagcggtgaaaatgccctgaagatcgacatccatgtcatcatcccgtatgaaggtctgagcgccgaccaaatggcccagatcgaagaggtgtttaaggtggtgtaccctgtggatgatcatcactttaaggtgatcctgccctatggcacactggtaatcgacggggttacgccgaacatgctgaactatttcggacggccgtatgaaggcatcgccgtgttcgacggcgagaagatcactgtaacagggaccctgtggaacggcaacaaaattatcgacgagcgcctgatcacccccgacggctccatgctgttccgagtaaccatcaacggcgttagcggctggcgcctgttcaagaagatcagc

SEQ ID NO: 694 - protein, 181 aa, Artificial sequence
  Synthetic
MKHHHHHHAIAMVFTLEDFVGDWEQTAAYNLDQVLEQGGVSSLLQNLAVSVTPIQRIVRSGENALKIDIHVIIPYEGLSADQMAQIEEVFKVVYPVDDHHFKVILPYGTLVIDGVTPNMLNYFGRPYEGIAVFDGEKITVTGTLWNGNKIIDERLITPDGSMLFRVTINGVSGWRLFKKIS

SEQ ID NO: 695 - DNA, 543 bp, Artificial sequence
  Synthetic
atgaaacatcaccatcaccatcatgcgatcgccatggtcttcacactcgaagatttcgttggggactgggaacagacagccgcctacaacctggaccaagtccttgaacagggaggtgtgtccagtttgctgcagaatctcgccgtgtccgtaactccgatccaaaggattgtccggagcggtgaaaatgccctgaagatcgacatccatgtcatcatcccgtatgaaggtctgagcgccgaccaaatggcccagatcgaagaggtgtttaaggtggtgtaccctgtggatgatcatcactttaaggtgatcctgccctatggcacactggtaatcgacggggttacgccgaacaagctgaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacggcgttagcggctggcgcctgttcaagaagatcagc

SEQ ID NO: 696 - protein, 181 aa, Artificial sequence
  Synthetic
MKHHHHHHAIAMVFTLEDFVGDWEQTAAYNLDQVLEQGGVSSLLQNLAVSVTPIQRIVRSGENALKIDIHVIIPYEGLSADQMAQIEEVFKVVYPVDDHHFKVILPYGTLVIDGVTPNKLNYFGRPYEGIAVFDGKKITVTGTLWNGNKIIDERLITPDGSMLFRVTINGVSGWRLFKKIS

SEQ ID NO: 697 - DNA, 543 bp, Artificial sequence
  Synthetic
atgaaacatcaccatcaccatcatgcgatcgccatggtcttcacactcgaagatttcgttggggactgggaacagacagccgcctacaacctggaccaagtccttgaacagggaggtgtgtccagtttgctgcagaatctcgccgtgtccgtaactccgatccaaaggattgtccggagcggtgaaaatgccctgaagatcgacatccatgtcatcatcccgtatgaaggtctgagcgccgaccaaatggcccagatcgaagaggtgtttaaggtggtgtaccctgtggatgatcatcactttaaggtgatcctgccctatggcacactggtaatcgacggggttacgccgaacatgctgaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatccagggcgttagcggctggcgcctgttcaagaagatcagc

SEQ ID NO: 698 - protein, 181 aa, Artificial sequence
  Synthetic
MKHHHHHHAIAMVFTLEDFVGDWEQTAAYNLDQVLEQGGVSSLLQNLAVSVTPIQRIVRSGENALKIDIHVIIPYEGLSADQMAQIEEVFKVVYPVDDHHFKVILPYGTLVIDGVTPNMLNYFGRPYEGIAVFDGKKITVTGTLWNGNKIIDERLITPDGSMLFRVTIQGVSGWRLFKKIS

SEQ ID NO: 699 - DNA, 543 bp, Artificial sequence
  Synthetic
atgaaacatcaccatcaccatcatgcgatcgccatggtcttcacactcgaagatttcgttggggactgggaacagacagccgcctacaacctggaccaagtccttgaacagggaggtgtgtccagtttgctgcagaatctcgccgtgtccgtaactccgatccaaaggattgtccggagcggtgaaaatgccctgaagatcgacatccatgtcatcatcccgtatgaaggtctgagcgccgaccaaatggcccagatcgaagaggtgtttaaggtggtgtaccctgtggatgatcatcactttaaggtgatcctgccctatggcacactggtaatcgacggggttacgccgaacatgctgaactatttcggacggccgtatgaaggcatcgccgtgttcgacggcaaaaagatcactgtaacagggaccctgtggaacggcaacaaaattatcgacgagcgcctgatcacccccgacaagaagatgctgttccgagtaaccatccagaaggttagcggctggcgcctgttcaagaagatcagc

SEQ ID NO: 700 - protein, 181 aa, Artificial sequence
  Synthetic
MKHHHHHHAIAMVFTLEDFVGDWEQTAAYNLDQVLEQGGVSSLLQNLAVSVTPIQRIVRSGENALKIDIHVIIPYEGLSADQMAQIEEVFKVVYPVDDHHFKVILPYGTLVIDGVTPNMLNYFGRPYEGIAVFDGKKITVTGTLWNGNKIIDERLITPDKKMLFRVTIQKVSGWRLFKKIS

SEQ ID NO: 701 - DNA, 543 bp, Artificial sequence
  Synthetic
atgaaacatcaccatcaccatcatgcgatcgccatggtcttcacactcgaagatttcgttggggactgggaacagacagccgcctacaacctggaccaagtccttgaacagggaggtgtgtccagtttgctgcagaatctcgccgtgtccgtaactccgatcatgaggattgtccggagcggtgaaaatgccctgaagatcgacatccatgtcatcatcccgtatgaaggtctgagcgccgaccaaatggcccagatcgaagaggtgtttaaggtggtgtaccctgtggatgatcatcactttaaggtgatcctgccctatggcacactggtaatcgacggggttacgccgaacatgctgaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacggcgttagcggctggcgcctgttcaagaagatcagc

SEQ ID NO: 702 - protein, 181 aa, Artificial sequence
  Synthetic
MKHHHHHHAIAMVFTLEDFVGDWEQTAAYNLDQVLEQGGVSSLLQNLAVSVTPIMRIVRSGENALKIDIHVIIPYEGLSADQMAQIEEVFKVVYPVDDHHFKVILPYGTLVIDGVTPNMLNYFGRPYEGIAVFDGKKITVTGTLWNGNKIIDERLITPDGSMLFRVTINGVSGWRLFKKIS

SEQ ID NO: 703 - DNA, 543 bp, Artificial sequence
  Synthetic
atgaaacatcaccatcaccatcatgcgatcgccatggtcttcacactcgaagatttcgttggggactgggaacagacagccgcctacaacctggaccaagtccttgaacagggaggtgtgtccagtttgctgcagaatctcgccgtgtccgtaactccgatccaaaggattgtccggagcggtgaaaatgccctgaagatcgacatccatgtcatcatcccgtatgaaggtctgagcgccgaccaaatggcccagatcgaagaggtgtttaaggtggtgtaccctgtggatgatcatcactttaaggtgatcctgccctatggcacactggtaatcgacggggttacgccgaacatgctgaactatttcggacacccgtatgaaggcatcgccgtgttcgacggcaaaaagatcactgtaacagggaccctgtggaacggcaacaaaattatcgacgagcgcctgatcacccccgacggctccatgctgttccgagtaaccatcaacggcgttagcggctggcgcctgttcaagaagatcagc

SEQ ID NO: 704 - protein, 181 aa, Artificial sequence
  Synthetic
MKHHHHHHAIAMVFTLEDFVGDWEQTAAYNLDQVLEQGGVSSLLQNLAVSVTPIQRIVRSGENALKIDIHVIIPYEGLSADQMAQIEEVFKVVYPVDDHHFKVILPYGTLVIDGVTPNMLNYFGHPYEGIAVFDGKKITVTGTLWNGNKIIDERLITPDGSMLFRVTINGVSGWRLFKKIS

SEQ ID NO: 705 - DNA, 543 bp, Artificial sequence
  Synthetic
atgaaacatcaccatcaccatcatgcgatcgccatggtcttcacactcgaagatttcgttggggactgggaacagacagccgcctacaacctggaccaagtccttgaacagggaggtgtgtccagtttgctgcagaatctcgccgtgtccgtaactccgatccaaaggattgtccggagcggtgaaaatgccctgaagatcgacatccatgtcatcatcccgtatgaaggtctgagcgccgaccaaatggcccagatcgaagaggtgtttaaggtggtgtaccctgtggatgatcatcactttaaggtgatcctgccctatggcacactggtaatcgacggggttacgccgaacatgctgaactatttcggacggccgtatgaaggcatcgccgtgttcgacggcaaaaagatcactgtaacagggaccctgtggaacggcaacaaaattatcgacgagcgcctgatcacccccgacggcaagatgctgttccgagtaaccatcaacggcgttagcggctggcgcctgttcaagaagatcagc

SEQ ID NO: 706 - protein, 181 aa, Artificial sequence
  Synthetic
MKHHHHHHAIAMVFTLEDFVGDWEQTAAYNLDQVLEQGGVSSLLQNLAVSVTPIQRIVRSGENALKIDIHVIIPYEGLSADQMAQIEEVFKVVYPVDDHHFKVILPYGTLVIDGVTPNMLNYFGRPYEGIAVFDGKKITVTGTLWNGNKIIDERLITPDGKMLFRVTINGVSGWRLFKKIS

SEQ ID NO: 707 - DNA, 543 bp, Artificial sequence
  Synthetic
atgaaacatcaccatcaccatcatgcgatcgccatggtcttcacactcgaagatttcgttggggactgggaacagacagccgcctacaacctggaccaagtccttgaacagggaggtgtgtccagtttgctgcagaatctcgccgtgtccgtaactccgatccaaaggattgtccggagcggtgaaaatgccctgaagatcgacatccatgtcatcatcccgtatgaaggtctgagcgccgaccaaatggcccagatcgaagaggtgtttaaggtggtgtaccctgtggatgatcatcactttaaggtgatcctgccctatggcacactggtaatcgacggggttacgccgaacatgctgaactatttcggacggccgtatgaaggcatcgccgtgttcgacggcaaaaagatcactgtaacagggaccctgtggaacggcaacaaaattatcgacgagcgcctgatcgatcccgacggctccatgctgttccgagtaaccatcaacggcgttagcggctggcgcctgttcaagaagatcagc

SEQ ID NO: 708 - protein, 181 aa, Artificial sequence
  Synthetic
MKHHHHHHAIAMVFTLEDFVGDWEQTAAYNLDQVLEQGGVSSLLQNLAVSVTPIQRIVRSGENALKIDIHVIIPYEGLSADQMAQIEEVFKVVYPVDDHHFKVILPYGTLVIDGVTPNMLNYFGRPYEGIAVFDGKKITVTGTLWNGNKIIDERLIDPDGSMLFRVTINGVSGWRLFKKIS

SEQ ID NO: 709 - DNA, 543 bp, Artificial sequence
  Synthetic
atgaaacatcaccatcaccatcatgcgatcgccatggatttcacactcgaagatttcgttggggactgggaacagacagccgcctacaacctggaccaagtccttgaacagggaggtgtgtccagtttgctgcagaatctcgccgtgtccgtaactccgatccaaaggattgtccggagcggtgaaaatgccctgaagatcgacatccatgtcatcatcccgtatgaaggtctgagcgccgaccaaatggcccagatcgaagaggtgtttaaggtggtgtaccctgtggatgatcatcactttaaggtgatcctgccctatggcacactggtaatcgacggggttacgccgaacatgctgaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacggcgttagcggctggcgcctgttcaagaagatcagc

SEQ ID NO: 710 - protein, 181 aa, Artificial sequence
  Synthetic
MKHHHHHHAIAMDFTLEDFVGDWEQTAAYNLDQVLEQGGVSSLLQNLAVSVTPIQRIVRSGENALKIDIHVIIPYEGLSADQMAQIEEVFKVVYPVDDHHFKVILPYGTLVIDGVTPNMLNYFGRPYEGIAVFDGKKITVTGTLWNGNKIIDERLITPDGSMLFRVTINGVSGWRLFKKIS

SEQ ID NO: 711 - DNA, 543 bp, Artificial sequence
  Synthetic
atgaaacatcaccatcaccatcatgcgatcgccatggtcttcacactcgaagatttcgttggggactgggaacagacagccgcctacaacctggaccaagtccttgaacagggaggtgtgtccagtttgctgcagaatctcgccgtgtccgtaactccgatccaaaggattgtccggagcggtgaaaatgccctgaagatcgacatccatgtcatcatcccgtatgaaggtctgagcgccgaccaaatggcccagatcgaagaggtgtttaaggtggtgtaccctgtggatgatcatcactttaaggtgatcctgccctatggcacactggtaatcgacggggttacgccgaacatgctgaactatttcggacggccgtatgaaggcatcgccgtgttcgacggcaaaaagatcactaccacagggaccctgtggaacggcaacaaaattatcgacgagcgcctgatcacccccgacggctccatgctgttccgagtaaccatcaacggcgttagcggctggcgcctgttcaagaagatcagc

SEQ ID NO: 712 - protein, 181 aa, Artificial sequence
  Synthetic
MKHHHHHHAIAMVFTLEDFVGDWEQTAAYNLDQVLEQGGVSSLLQNLAVSVTPIQRIVRSGENALKIDIHVIIPYEGLSADQMAQIEEVFKVVYPVDDHHFKVILPYGTLVIDGVTPNMLNYFGRPYEGIAVFDGKKITTTGTLWNGNKIIDERLITPDGSMLFRVTINGVSGWRLFKKIS

SEQ ID NO: 713 - DNA, 543 bp, Artificial sequence
  Synthetic
atgaaacatcaccatcaccatcatgcgatcgccatggtcttcacactcgaagatttcgttggggactgggaacagacagccgcctacaacctggaccaagtccttgaacagggaggtgtgtccagtttgctgcagaatctcgccgtgtccgtaactccgatccaaaggattgtccggagcggtgaaaatgccctgaagatcgacatccatgtcatcatcccgtatgaaggtctgagcgccgaccaaatggcccagatcgaagaggtgtttaaggtggtgtaccctgtggatgatcatcactttaaggtgatcctgcccatcggcacactggtaatcgacggggttacgccgaacatgctgaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacggcgttagcggctggcgcctgttcaagaagatcagc

SEQ ID NO: 714 - protein, 181 aa, Artificial sequence
  Synthetic
MKHHHHHHAIAMVFTLEDFVGDWEQTAAYNLDQVLEQGGVSSLLQNLAVSVTPIQRIVRSGENALKIDIHVIIPYEGLSADQMAQIEEVFKVVYPVDDHHFKVILPIGTLVIDGVTPNMLNYFGRPYEGIAVFDGKKITVTGTLWNGNKIIDERLITPDGSMLFRVTINGVSGWRLFKKIS

SEQ ID NO: 715 - DNA, 543 bp, Artificial sequence
  Synthetic
atgaaacatcaccatcaccatcatgcgatcgccatggtcttcacactcgaagatttcgttggggactgggaacagacagccgcctacaacctggaccaagtccttgaacagggaggtgtgtccagtttgctgcagaatctcgccgtgtccgtaactccgatccaaaggattgtccggagcggtgaaaatgccctgaagatcgacatccatgtcatcatcccgtatgaaggtctgagcgccgaccaaatggcccagatcgaagaggtgtttaaggtggtgtaccctgtggatgatcatcactttaaggtgatcctgccctatggcacactggtaatcgacggggttacgccgaacatgctgaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacggcgtgaccggctggcggctgtgcgaacgcattctg

SEQ ID NO: 716 - protein, 181 aa, Artificial sequence
  Synthetic
MKHHHHHHAIAMVFTLEDFVGDWEQTAAYNLDQVLEQGGVSSLLQNLAVSVTPIQRIVRSGENALKIDIHVIIPYEGLSADQMAQIEEVFKVVYPVDDHHFKVILPYGTLVIDGVTPNMLNYFGRPYEGIAVFDGKKITVTGTLWNGNKIIDERLITPDGSMLFRVTINGVTGWRLCERIL

SEQ ID NO: 717 - DNA, 543 bp, Artificial sequence
  Synthetic
atgaaacatcaccatcaccatcatgcgatcgccatggatttcacactcgacgatttcgttggggactgggaacagacagccgcctacaacctggaccaagtccttgaacagggaggtgtgtccagtttgctgcagaatctcgccgtgtccgtaactccgatcatgaggattgtccggagcggtgaaaatgccctgaagatcgacatccatgtcatcatcccgtatgaaggtctgagcgccgaccaaatggcccagatcgaagaggtgtttaaggtggtgtaccctgtggatgatcatcactttaaggtgatcctgcccatcggcacactggtaatcgacggggttacgccgaacaagctgaactatttcggacacccgtatgaaggcatcgccgtgttcgacggcgagaagatcactaccacagggaccctgtggaacggcaacaaaattatcgacgagcgcctgatcgatcccgacaagaagatgctgttccgagtaaccatccagaaggttagcggctggcgcctgttcaagaagatcagc

SEQ ID NO: 718 - protein, 181 aa, Artificial sequence
  Synthetic
MKHHHHHHAIAMDFTLDDFVGDWEQTAAYNLDQVLEQGGVSSLLQNLAVSVTPIMRIVRSGENALKIDIHVIIPYEGLSADQMAQIEEVFKVVYPVDDHHFKVILPIGTLVIDGVTPNKLNYFGHPYEGIAVFDGEKITTTGTLWNGNKIIDERLIDPDKKMLFRVTIQKVSGWRLFKKIS

SEQ ID NO: 719 - DNA, 543 bp, Artificial sequence
  Synthetic
atgaaacatcaccatcaccatcatgcgatcgccatggatttcacactcgacgatttcgttggggactgggaacagacagccgcctacaacctggaccaagtccttgaacagggaggtgtgtccagtttgctgcagaatctcgccgtgtccgtaactccgatcatgaggattgtccggagcggtgaaaatgccctgaagatcgacatccatgtcatcatcccgtatgaaggtctgagcgccgaccaaatggcccagatcgaagaggtgtttaaggtggtgtaccctgtggatgatcatcactttaaggtgatcctgcccatcggcacactggtaatcgacggggttacgccgaacaagctgaactatttcggacacccgtatgaaggcatcgccgtgttcgacggcgagaagatcactaccacagggaccctgtggaacggcaacaaaattatcgacgagcgcctgatcgatcccgacggctccatgctgttccgagtaaccatcaacggcgttagcggctggcgcctgttcaagaagatcagc

SEQ ID NO: 720 - protein, 181 aa, Artificial sequence; identical to SEQ ID NO: 718
  Synthetic

SEQ ID NO: 721 - DNA, 522 bp, Artificial sequence
  Synthetic
atgaacgtgagcggctggcggctgttcaagaagattagcaacggctcgagcggtggctcgagcggtttcacactcgacgatttcgttggggactgggaacagacagccgcctacaacctggaccaagtccttgaacagggaggtgtgtccagtttgctgcagaatctcgccgtgtccgtaactccgatcatgaggattgtccggagcggtgaaaatgccctgaagatcgacatccatgtcatcatcccgtatgaaggtctgagcgccgaccaaatggcccagatcgaagaggtgtttaaggtggtgtaccctgtggatgatcatcactttaaggtgatcctgccctatggcacactggtaatcgacggggttacgccgaacaagctgaactatttcggacggccgtatgaaggcatcgccgtgttcgacggcaaaaagatcactaccacagggaccctgtggaacggcaacaaaattatcgacgagcgcctgatcacccccgaccatcaccatcaccatcat

SEQ ID NO: 722 - protein, 174 aa, Artificial sequence
  Synthetic
MNVSGWRLFKKISNGSSGGSSGFTLDDFVGDWEQTAAYNLDQVLEQGGVSSLLQNLAVSVTPIMRIVRSGENALKIDIHVIIPYEGLSADQMAQIEEVFKVVYPVDDHHFKVILPYGTLVIDGVTPNKLNYFGRPYEGIAVFDGKKITTTGTLWNGNKIIDERLITPDHHHHHH

SEQ ID NO: 723 - DNA, 522 bp, Artificial sequence
  Synthetic
atgaacgtgaccggctaccggctgttcaagaagattagcaacggctcgagcggtggctcgagcggtttcacactcgacgatttcgttggggactgggaacagacagccgcctacaacctggaccaagtccttgaacagggaggtgtgtccagtttgctgcagaatctcgccgtgtccgtaactccgatcatgaggattgtccggagcggtgaaaatgccctgaagatcgacatccatgtcatcatcccgtatgaaggtctgagcgccgaccaaatggcccagatcgaagaggtgtttaaggtggtgtaccctgtggatgatcatcactttaaggtgatcctgccctatggcacactggtaatcgacggggttacgccgaacaagctgaactatttcggacggccgtatgaaggcatcgccgtgttcgacggcaaaaagatcactaccacagggaccctgtggaacggcaacaaaattatcgacgagcgcctgatcacccccgaccatcaccatcaccatcat

SEQ ID NO: 724 - protein, 174 aa, Artificial sequence
  Synthetic
MNVTGYRLFKKISNGSSGGSSGFTLDDFVGDWEQTAAYNLDQVLEQGGVSSLLQNLAVSVTPIMRIVRSGENALKIDIHVIIPYEGLSADQMAQIEEVFKVVYPVDDHHFKVILPYGTLVIDGVTPNKLNYFGRPYEGIAVFDGKKITTTGTLWNGNKIIDERLITPDHHHHHH

SEQ ID NO: 725 - DNA, 516 bp, Artificial sequence
  Synthetic
atggtgaccggctaccggctgttcgagaagattagcggctcgagcggtggctcgagcggtttcacactcgacgatttcgttggggactgggaacagacagccgcctacaacctggaccaagtccttgaacagggaggtgtgtccagtttgctgcagaatctcgccgtgtccgtaactccgatcatgaggattgtccggagcggtgaaaatgccctgaagatcgacatccatgtcatcatcccgtatgaaggtctgagcgccgaccaaatggcccagatcgaagaggtgtttaaggtggtgtaccctgtggatgatcatcactttaaggtgatcctgccctatggcacactggtaatcgacggggttacgccgaacaagctgaactatttcggacggccgtatgaaggcatcgccgtgttcgacggcaaaaagatcactaccacagggaccctgtggaacggcaacaaaattatcgacgagcgcctgatcacccccgaccatcaccatcaccatcat

SEQ ID NO: 726 - protein, 172 aa, Artificial sequence
  Synthetic
MVTGYRLFEKISGSSGGSSGFTLDDFVGDWEQTAAYNLDQVLEQGGVSSLLQNLAVSVTPIMRIVRSGENALKIDIHVIIPYEGLSADQMAQIEEVFKVVYPVDDHHFKVILPYGTLVIDGVTPNKLNYFGRPYEGIAVFDGKKITTTGTLWNGNKIIDERLITPDHHHHHH

SEQ ID NO: 727 - DNA, 516 bp, Artificial sequence
  Synthetic
atggtgaccggctaccggctgttcgagaagattctgggctcgagcggtggctcgagcggtttcacactcgacgatttcgttggggactgggaacagacagccgcctacaacctggaccaagtccttgaacagggaggtgtgtccagtttgctgcagaatctcgccgtgtccgtaactccgatcatgaggattgtccggagcggtgaaaatgccctgaagatcgacatccatgtcatcatcccgtatgaaggtctgagcgccgaccaaatggcccagatcgaagaggtgtttaaggtggtgtaccctgtggatgatcatcactttaaggtgatcctgccctatggcacactggtaatcgacggggttacgccgaacaagctgaactatttcggacggccgtatgaaggcatcgccgtgttcgacggcaaaaagatcactaccacagggaccctgtggaacggcaacaaaattatcgacgagcgcctgatcacccccgaccatcaccatcaccatcat

SEQ ID NO: 728 - protein, 172 aa, Artificial sequence
  Synthetic
MVTGYRLFEKILGSSGGSSGFTLDDFVGDWEQTAAYNLDQVLEQGGVSSLLQNLAVSVTPIMRIVRSGENALKIDIHVIIPYEGLSADQMAQIEEVFKVVYPVDDHHFKVILPYGTLVIDGVTPNKLNYFGRPYEGIAVFDGKKITTTGTLWNGNKIIDERLITPDHHHHHH

SEQ ID NO: 729 - DNA, 516 bp, Artificial sequence
  Synthetic
atggtgagcggctggcggctgttcaagaagattagcggctcgagcggtggctcgagcggtttcacactcgacgatttcgttggggactgggaacagacagccgcctacaacctggaccaagtccttgaacagggaggtgtgtccagtttgctgcagaatctcgccgtgtccgtaactccgatcatgaggattgtccggagcggtgaaaatgccctgaagatcgacatccatgtcatcatcccgtatgaaggtctgagcgccgaccaaatggcccagatcgaagaggtgtttaaggtggtgtaccctgtggatgatcatcactttaaggtgatcctgccctatggcacactggtaatcgacggggttacgccgaacaagctgaactatttcggacggccgtatgaaggcatcgccgtgttcgacggcaaaaagatcactaccacagggaccctgtggaacggcaacaaaattatcgacgagcgcctgatcacccccgaccatcaccatcaccatcat

SEQ ID NO: 730 - protein, 172 aa, Artificial sequence
  Synthetic
MVSGWRLFKKISGSSGGSSGFTLDDFVGDWEQTAAYNLDQVLEQGGVSSLLQNLAVSVTPIMRIVRSGENALKIDIHVIIPYEGLSADQMAQIEEVFKVVYPVDDHHFKVILPYGTLVIDGVTPNKLNYFGRPYEGIAVFDGKKITTTGTLWNGNKIIDERLITPDHHHHHH

SEQ ID NO: 731 - DNA, 516 bp, Artificial sequence
  Synthetic
atggtgagcggctggcggctgttcaagaagattggcggctcgagcggtggctcgagcggtttcacactcgacgatttcgttggggactgggaacagacagccgcctacaacctggaccaagtccttgaacagggaggtgtgtccagtttgctgcagaatctcgccgtgtccgtaactccgatcatgaggattgtccggagcggtgaaaatgccctgaagatcgacatccatgtcatcatcccgtatgaaggtctgagcgccgaccaaatggcccagatcgaagaggtgtttaaggtggtgtaccctgtggatgatcatcactttaaggtgatcctgccctatggcacactggtaatcgacggggttacgccgaacaagctgaactatttcggacggccgtatgaaggcatcgccgtgttcgacggcaaaaagatcactaccacagggaccctgtggaacggcaacaaaattatcgacgagcgcctgatcacccccgaccatcaccatcaccatcat

SEQ ID NO: 732 - protein, 172 aa, Artificial sequence
  Synthetic
MVSGWRLFKKIGGSSGGSSGFTLDDFVGDWEQTAAYNLDQVLEQGGVSSLLQNLAVSVTPIMRIVRSGENALKIDIHVIIPYEGLSADQMAQIEEVFKVVYPVDDHHFKVILPYGTLVIDGVTPNKLNYFGRPYEGIAVFDGKKITTTGTLWNGNKIIDERLITPDHHHHHH

SEQ ID NO: 733 - DNA, 516 bp, Artificial sequence
  Synthetic
atggtgagcggctggcggctgttcaagaagtcgggcggctcgagcggtggctcgagcggtttcacactcgacgatttcgttggggactgggaacagacagccgcctacaacctggaccaagtccttgaacagggaggtgtgtccagtttgctgcagaatctcgccgtgtccgtaactccgatcatgaggattgtccggagcggtgaaaatgccctgaagatcgacatccatgtcatcatcccgtatgaaggtctgagcgccgaccaaatggcccagatcgaagaggtgtttaaggtggtgtaccctgtggatgatcatcactttaaggtgatcctgccctatggcacactggtaatcgacggggttacgccgaacaagctgaactatttcggacggccgtatgaaggcatcgccgtgttcgacggcaaaaagatcactaccacagggaccctgtggaacggcaacaaaattatcgacgagcgcctgatcacccccgaccatcaccatcaccatcat

SEQ ID NO: 734 - protein, 172 aa, Artificial sequence
  Synthetic
MVSGWRLFKKSGGSSGGSSGFTLDDFVGDWEQTAAYNLDQVLEQGGVSSLLQNLAVSVTPIMRIVRSGENALKIDIHVIIPYEGLSADQMAQIEEVFKVVYPVDDHHFKVILPYGTLVIDGVTPNKLNYFGRPYEGIAVFDGKKITTTGTLWNGNKIIDERLITPDHHHHHH

SEQ ID NO: 735 - DNA, 510 bp, Artificial sequence
  Synthetic
atggtgagcggctggcggctgttcaagaagggctcgagcggtggctcgagcggtttcacactcgacgatttcgttggggactgggaacagacagccgcctacaacctggaccaagtccttgaacagggaggtgtgtccagtttgctgcagaatctcgccgtgtccgtaactccgatcatgaggattgtccggagcggtgaaaatgccctgaagatcgacatccatgtcatcatcccgtatgaaggtctgagcgccgaccaaatggcccagatcgaagaggtgtttaaggtggtgtaccctgtggatgatcatcactttaaggtgatcctgccctatggcacactggtaatcgacggggttacgccgaacaagctgaactatttcggacggccgtatgaaggcatcgccgtgttcgacggcaaaaagatcactaccacagggaccctgtggaacggcaacaaaattatcgacgagcgcctgatcacccccgaccatcaccatcaccatcat

SEQ ID NO: 736 - protein, 170 aa, Artificial sequence
  Synthetic
MVSGWRLFKKGSSGGSSGFTLDDFVGDWEQTAAYNLDQVLEQGGVSSLLQNLAVSVTPIMRIVRSGENALKIDIHVIIPYEGLSADQMAQIEEVFKVVYPVDDHHFKVILPYGTLVIDGVTPNKLNYFGRPYEGIAVFDGKKITTTGTLWNGNKIIDERLITPDHHHHHH

SEQ ID NO: 737 - DNA, 513 bp, Artificial sequence
  Synthetic
atggtgagcggctggcggctgttcaagaagattggctcgagcggtggctcgagcggtttcacactcgacgatttcgttggggactgggaacagacagccgcctacaacctggaccaagtccttgaacagggaggtgtgtccagtttgctgcagaatctcgccgtgtccgtaactccgatcatgaggattgtccggagcggtgaaaatgccctgaagatcgacatccatgtcatcatcccgtatgaaggtctgagcgccgaccaaatggcccagatcgaagaggtgtttaaggtggtgtaccctgtggatgatcatcactttaaggtgatcctgccctatggcacactggtaatcgacggggttacgccgaacaagctgaactatttcggacggccgtatgaaggcatcgccgtgttcgacggcaaaaagatcactaccacagggaccctgtggaacggcaacaaaattatcgacgagcgcctgatcacccccgaccatcaccatcaccatcat

SEQ ID NO: 738 - protein, 171 aa, Artificial sequence
  Synthetic
MVSGWRLFKKIGSSGGSSGFTLDDFVGDWEQTAAYNLDQVLEQGGVSSLLQNLAVSVTPIMRIVRSGENALKIDIHVIIPYEGLSADQMAQIEEVFKVVYPVDDHHFKVILPYGTLVIDGVTPNKLNYFGRPYEGIAVFDGKKITTTGTLWNGNKIIDERLITPDHHHHHH

SEQ ID NO: 739 - DNA, 522 bp, Artificial sequence
  Synthetic
atggtttccgtgagcggctggcggctgttcaagaagtcgggcggctcgagcggtggctcgagcggtttcacactcgacgatttcgttggggactgggaacagacagccgcctacaacctggaccaagtccttgaacagggaggtgtgtccagtttgctgcagaatctcgccgtgtccgtaactccgatcatgaggattgtccggagcggtgaaaatgccctgaagatcgacatccatgtcatcatcccgtatgaaggtctgagcgccgaccaaatggcccagatcgaagaggtgtttaaggtggtgtaccctgtggatgatcatcactttaaggtgatcctgccctatggcacactggtaatcgacggggttacgccgaacaagctgaactatttcggacggccgtatgaaggcatcgccgtgttcgacggcaaaaagatcactaccacagggaccctgtggaacggcaacaaaattatcgacgagcgcctgatcacccccgaccatcaccatcaccatcat

SEQ ID NO: 740 - protein, 174 aa, Artificial sequence
  Synthetic
MVSVSGWRLFKKSGGSSGGSSGFTLDDFVGDWEQTAAYNLDQVLEQGGVSSLLQNLAVSVTPIMRIVRSGENALKIDIHVIIPYEGLSADQMAQIEEVFKVVYPVDDHHFKVILPYGTLVIDGVTPNKLNYFGRPYEGIAVFDGKKITTTGTLWNGNKIIDERLITPDHHHHHH

SEQ ID NO: 741 - DNA, 522 bp, Artificial sequence
  Synthetic
atggtttccgtgagcggctggcggctgttcaagaagattggcggctcgagcggtggctcgagcggtttcacactcgacgatttcgttggggactgggaacagacagccgcctacaacctggaccaagtccttgaacagggaggtgtgtccagtttgctgcagaatctcgccgtgtccgtaactccgatcatgaggattgtccggagcggtgaaaatgccctgaagatcgacatccatgtcatcatcccgtatgaaggtctgagcgccgaccaaatggcccagatcgaagaggtgtttaaggtggtgtaccctgtggatgatcatcactttaaggtgatcctgccctatggcacactggtaatcgacggggttacgccgaacaagctgaactatttcggacggccgtatgaaggcatcgccgtgttcgacggcaaaaagatcactaccacagggaccctgtggaacggcaacaaaattatcgacgagcgcctgatcacccccgaccatcaccatcaccatcat

SEQ ID NO: 742 - protein, 174 aa, Artificial sequence
  Synthetic
MVSVSGWRLFKKIGGSSGGSSGFTLDDFVGDWEQTAAYNLDQVLEQGGVSSLLQNLAVSVTPIMRIVRSGENALKIDIHVIIPYEGLSADQMAQIEEVFKVVYPVDDHHFKVILPYGTLVIDGVTPNKLNYFGRPYEGIAVFDGKKITTTGTLWNGNKIIDERLITPDHHHHHH

SEQ ID NO: 743 - DNA, 516 bp, Artificial sequence
  Synthetic
atggtttccgtgagcggctggcggctgttcaagaagggctcgagcggtggctcgagcggtttcacactcgacgatttcgttggggactgggaacagacagccgcctacaacctggaccaagtccttgaacagggaggtgtgtccagtttgctgcagaatctcgccgtgtccgtaactccgatcatgaggattgtccggagcggtgaaaatgccctgaagatcgacatccatgtcatcatcccgtatgaaggtctgagcgccgaccaaatggcccagatcgaagaggtgtttaaggtggtgtaccctgtggatgatcatcactttaaggtgatcctgccctatggcacactggtaatcgacggggttacgccgaacaagctgaactatttcggacggccgtatgaaggcatcgccgtgttcgacggcaaaaagatcactaccacagggaccctgtggaacggcaacaaaattatcgacgagcgcctgatcacccccgaccatcaccatcaccatcat

SEQ ID NO: 744 - protein, 172 aa, Artificial sequence
  Synthetic
MVSVSGWRLFKKGSSGGSSGFTLDDFVGDWEQTAAYNLDQVLEQGGVSSLLQNLAVSVTPIMRIVRSGENALKIDIHVIIPYEGLSADQMAQIEEVFKVVYPVDDHHFKVILPYGTLVIDGVTPNKLNYFGRPYEGIAVFDGKKITTTGTLWNGNKIIDERLITPDHHHHHH

SEQ ID NO: 745 - DNA, 518 bp, Artificial sequence
  Synthetic
atggtttccgtgagcggctggcggctgttcaagaagattggctcgagcggtggctcgagcggtttcacactcgacgatttcgttggggactgggaacagacagccgcctacaacctggaccaagtccttgaacagggaggtgtgtccagtttgctgcagaatctcgccgtgtccgtaactccgatcatgaggattgtccggagcggtgaaaatgccctgaagatcgacatccatgtcatcatcccgtatgaaggtctgagcgccgaccaaatggcccagatcgaagaggtgtttaaggtggtgtaccctgtggatgatcatcactttaaggtgatcctgccctatggcacactggtaatcgacggggttacgccgaacaagctgaactatttcggacggccgtatgaaggcatcgccgtgttcgacggcaaaaagatcactaccacagggaccctgtggaacggcaacaaaattatcgacgagcgcctgatcacccccgaccatcaccatcaccatca

SEQ ID NO: 746 - protein, 173 aa, Artificial sequence
  Synthetic
MVSVSGWRLFKKIGSSGGSSGFTLDDFVGDWEQTAAYNLDQVLEQGGVSSLLQNLAVSVTPIMRIVRSGENALKIDIHVIIPYEGLSADQMAQIEEVFKVVYPVDDHHFKVILPYGTLVIDGVTPNKLNYFGRPYEGIAVFDGKKITTTGTLWNGNKIIDERLITPDHHHHHH

SEQ ID NO: 747 - DNA, 513 bp, Artificial sequence
  Synthetic
atgaacgtgagcggctggcggctgttcaagaagattagcaacggctcgagcggttcgttcacactcgacgatttcgttggggactgggaacagacagccgcctacaacctggaccaagtccttgaacagggaggtgtgtccagtttgctgcagaatctcgccgtgtccgtaactccgatcatgaggattgtccggagcggtgaaaatgccctgaagatcgacatccatgtcatcatcccgtatgaaggtctgagcgccgaccaaatggcccagatcgaagaggtgtttaaggtggtgtaccctgtggatgatcatcactttaaggtgatcctgccctatggcacactggtaatcgacggggttacgccgaacaagctgaactatttcggacggccgtatgaaggcatcgccgtgttcgacggcaaaaagatcactaccacagggaccctgtggaacggcaacaaaattatcgacgagcgcctgatcacccccgaccatcaccatcaccatcat

SEQ ID NO: 748 - protein, 171 aa, Artificial sequence
  Synthetic
MNVSGWRLFKKISNGSSGSFTLDDFVGDWEQTAAYNLDQVLEQGGVSSLLQNLAVSVTPIMRIVRSGENALKIDIHVIIPYEGLSADQMAQIEEVFKVVYPVDDHHFKVILPYGTLVIDGVTPNKLNYFGRPYEGIAVFDGKKITTTGTLWNGNKIIDERLITPDHHHHHH

SEQ ID NO: 749 - DNA, 516 bp, Artificial sequence
  Synthetic
atgaacgtgagcggctggcggctgttcaagaagattagcaacggctcgagcggtggctcgttcacactcgacgatttcgttggggactgggaacagacagccgcctacaacctggaccaagtccttgaacagggaggtgtgtccagtttgctgcagaatctcgccgtgtccgtaactccgatcatgaggattgtccggagcggtgaaaatgccctgaagatcgacatccatgtcatcatcccgtatgaaggtctgagcgccgaccaaatggcccagatcgaagaggtgtttaaggtggtgtaccctgtggatgatcatcactttaaggtgatcctgccctatggcacactggtaatcgacggggttacgccgaacaagctgaactatttcggacggccgtatgaaggcatcgccgtgttcgacggcaaaaagatcactaccacagggaccctgtggaacggcaacaaaattatcgacgagcgcctgatcacccccgaccatcaccatcaccatcat

SEQ ID NO: 750 - protein, 172 aa, Artificial sequence
  Synthetic
MNVSGWRLFKKISNGSSGGSFTLDDFVGDWEQTAAYNLDQVLEQGGVSSLLQNLAVSVTPIMRIVRSGENALKIDIHVIIPYEGLSADQMAQIEEVFKVVYPVDDHHFKVILPYGTLVIDGVTPNKLNYFGRPYEGIAVFDGKKITTTGTLWNGNKIIDERLITPDHHHHHH

SEQ ID NO: 751 - DNA, 519 bp, Artificial sequence
  Synthetic
atgaacgtgagcggctggcggctgttcaagaagattagcaacggctcgagcggtggctcgggtttcacactcgacgatttcgttggggactgggaacagacagccgcctacaacctggaccaagtccttgaacagggaggtgtgtccagtttgctgcagaatctcgccgtgtccgtaactccgatcatgaggattgtccggagcggtgaaaatgccctgaagatcgacatccatgtcatcatcccgtatgaaggtctgagcgccgaccaaatggcccagatcgaagaggtgtttaaggtggtgtaccctgtggatgatcatcactttaaggtgatcctgccctatggcacactggtaatcgacggggttacgccgaacaagctgaactatttcggacggccgtatgaaggcatcgccgtgttcgacggcaaaaagatcactaccacagggaccctgtggaacggcaacaaaattatcgacgagcgcctgatcacccccgaccatcaccatcaccatcat

SEQ ID NO: 752 - protein, 173 aa, Artificial sequence
  Synthetic
MNVSGWRLFKKISNGSSGGSGFTLDDFVGDWEQTAAYNLDQVLEQGGVSSLLQNLAVSVTPIMRIVRSGENALKIDIHVIIPYEGLSADQMAQIEEVFKVVYPVDDHHFKVILPYGTLVIDGVTPNKLNYFGRPYEGIAVFDGKKITTTGTLWNGNKIIDERLITPDHHHHHH

SEQ ID NO: 753 - DNA, 525 bp, Artificial sequence
  Synthetic
atgaacgtgagcggctggcggctgttcaagaagattagcaacggctcgagcggtggctcgagcggtggtttcacactcgacgatttcgttggggactgggaacagacagccgcctacaacctggaccaagtccttgaacagggaggtgtgtccagtttgctgcagaatctcgccgtgtccgtaactccgatcatgaggattgtccggagcggtgaaaatgccctgaagatcgacatccatgtcatcatcccgtatgaaggtctgagcgccgaccaaatggcccagatcgaagaggtgtttaaggtggtgtaccctgtggatgatcatcactttaaggtgatcctgccctatggcacactggtaatcgacggggttacgccgaacaagctgaactatttcggacggccgtatgaaggcatcgccgtgttcgacggcaaaaagatcactaccacagggaccctgtggaacggcaacaaaattatcgacgagcgcctgatcacccccgaccatcaccatcaccatcat

SEQ ID NO: 754 - protein, 175 aa, Artificial sequence
  Synthetic
MNVSGWRLFKKISNGSSGGSSGGFTLDDFVGDWEQTAAYNLDQVLEQGGVSSLLQNLAVSVTPIMRIVRSGENALKIDIHVIIPYEGLSADQMAQIEEVFKVVYPVDDHHFKVILPYGTLVIDGVTPNKLNYFGRPYEGIAVFDGKKITTTGTLWNGNKIIDERLITPDHHHHHH

SEQ ID NO: 755 - DNA, 528 bp, Artificial sequence
  Synthetic
atgaacgtgagcggctggcggctgttcaagaagattagcaacggctcgagcggtggctcgagcggtggtagcttcacactcgacgatttcgttggggactgggaacagacagccgcctacaacctggaccaagtccttgaacagggaggtgtgtccagtttgctgcagaatctcgccgtgtccgtaactccgatcatgaggattgtccggagcggtgaaaatgccctgaagatcgacatccatgtcatcatcccgtatgaaggtctgagcgccgaccaaatggcccagatcgaagaggtgtttaaggtggtgtaccctgtggatgatcatcactttaaggtgatcctgccctatggcacactggtaatcgacggggttacgccgaacaagctgaactatttcggacggccgtatgaaggcatcgccgtgttcgacggcaaaaagatcactaccacagggaccctgtggaacggcaacaaaattatcgacgagcgcctgatcacccccgaccatcaccatcaccatcat

SEQ ID NO: 756 - protein, 176 aa, Artificial sequence
  Synthetic
MNVSGWRLFKKISNGSSGGSSGGSFTLDDFVGDWEQTAAYNLDQVLEQGGVSSLLQNLAVSVTPIMRIVRSGENALKIDIHVIIPYEGLSADQMAQIEEVFKVVYPVDDHHFKVILPYGTLVIDGVTPNKLNYFGRPYEGIAVFDGKKITTTGTLWNGNKIIDERLITPDHHHHHH

SEQ ID NO: 757 - DNA, 531 bp, Artificial sequence
  Synthetic
atgaacgtgagcggctggcggctgttcaagaagattagcaacggctcgagcggtggctcgagcggtggtagctcgttcacactcgacgatttcgttggggactgggaacagacagccgcctacaacctggaccaagtccttgaacagggaggtgtgtccagtttgctgcagaatctcgccgtgtccgtaactccgatcatgaggattgtccggagcggtgaaaatgccctgaagatcgacatccatgtcatcatcccgtatgaaggtctgagcgccgaccaaatggcccagatcgaagaggtgtttaaggtggtgtaccctgtggatgatcatcactttaaggtgatcctgccctatggcacactggtaatcgacggggttacgccgaacaagctgaactatttcggacggccgtatgaaggcatcgccgtgttcgacggcaaaaagatcactaccacagggaccctgtggaacggcaacaaaattatcgacgagcgcctgatcacccccgaccatcaccatcaccatcat

SEQ ID NO: 758 - protein, 177 aa, Artificial sequence
  Synthetic
MNVSGWRLFKKISNGSSGGSSGGSSFTLDDFVGDWEQTAAYNLDQVLEQGGVSSLLQNLAVSVTPIMRIVRSGENALKIDIHVIIPYEGLSADQMAQIEEVFKVVYPVDDHHFKVILPYGTLVIDGVTPNKLNYFGRPYEGIAVFDGKKITTTGTLWNGNKIIDERLITPDHHHHHH

SEQ ID NO: 759 - DNA, 522 bp, Artificial sequence
  Synthetic
atgaacgtgagcggctggcggctgttcaagaagattagcaacggctcgagcggtggctcgagcggtttcacactcgacgatttcgttggggactgggaacagacagccgcctacaacctggaccaagtccttgaacagggaggtgtgtccagtttgctgcagaatctcgccgtgtccgtaactccgatcatgaggattgtccggagcggtgaaaatgccctgaagatcgacatccatgtcatcatcccgtatgaaggtctgagcgccgaccaaatggcccagatcgaagaggtgtttaaggtggtgtaccctgtggatgatcatcactttaaggtgatcctgccctatggcacactggtaatcgacggggttacgccgaacaagctgaactatttcggacacccgtatgaaggcatcgccgtgttcgacggcgagaagatcactaccacagggaccctgtggaacggcaacaaaattatcgacgagcgcctgatcacccccgaccatcaccatcaccatcat

SEQ ID NO: 760 - protein, 174 aa, Artificial sequence
  Synthetic
MNVSGWRLFKKISNGSSGGSSGFTLDDFVGDWEQTAAYNLDQVLEQGGVSSLLQNLAVSVTPIMRIVRSGENALKIDIHVIIPYEGLSADQMAQIEEVFKVVYPVDDHHFKVILPYGTLVIDGVTPNKLNYFGHPYEGIAVFDGEKITTTGTLWNGNKIIDERLITPDHHHHHH

SEQ ID NO: 761 - DNA, 522 bp, Artificial sequence
  Synthetic
atgaacgtgagcggctggcggctgttcaagaagattagcaacggctcgagcggtggctcgagcggtttcacactcgacgatttcgttggggactgggaacagacagccgcctacaacctggaccaagtccttgaacagggaggtgtgtccagtttgctgcagaatctcgccgtgtccgtaactccgatcatgaggattgtccggagcggtgaaaatgccctgaagatcgacatccatgtcatcatcccgtatgaaggtctgagcgccgaccaaatggcccagatcgaagaggtgtttaaggtggtgtaccctgtggatgatcatcactttaaggtgatcctgccctatggcacactggtaatcgacggggttacgccgaacaagctgaactatttcggacacccgtatgaaggcatcgccgtgttcgacggcgagaagatcactaccacagggaccctgtggaacggcaacaaaattatcgacgagcgcctgatcgatcccgaccatcaccatcaccatcat

SEQ ID NO: 762 - protein, 174 aa, Artificial sequence
  Synthetic
MNVSGWRLFKKISNGSSGGSSGFTLDDFVGDWEQTAAYNLDQVLEQGGVSSLLQNLAVSVTPIMRIVRSGENALKIDIHVIIPYEGLSADQMAQIEEVFKVVYPVDDHHFKVILPYGTLVIDGVTPNKLNYFGHPYEGIAVFDGEKITTTGTLWNGNKIIDERLIDPDHHHHHH

SEQ ID NO: 763 - DNA, 531 bp, Artificial sequence
  Synthetic
atgaacgtgagcggctggcggctgttcaagaagattagcaacggctcgagcggtggctcgagcggtggtagctcgttcacactcgacgatttcgttggggactgggaacagacagccgcctacaacctggaccaagtccttgaacagggaggtgtgtccagtttgctgcagaatctcgccgtgtccgtaactccgatcatgaggattgtccggagcggtgaaaatgccctgaagatcgacatccatgtcatcatcccgtatgaaggtctgagcgccgaccaaatggcccagatcgaagaggtgtttaaggtggtgtaccctgtggatgatcatcactttaaggtgatcctgccctatggcacactggtaatcgacggggttacgccgaacaagctgaactatttcggacacccgtatgaaggcatcgccgtgttcgacggcgagaagatcactaccacagggaccctgtggaacggcaacaaaattatcgacgagcgcctgatcacccccgaccatcaccatcaccatcat

SEQ ID NO: 764 - protein, 177 aa, Artificial sequence
  Synthetic
MNVSGWRLFKKISNGSSGGSSGGSSFTLDDFVGDWEQTAAYNLDQVLEQGGVSSLLQNLAVSVTPIMRIVRSGENALKIDIHVIIPYEGLSADQMAQIEEVFKVVYPVDDHHFKVILPYGTLVIDGVTPNKLNYFGHPYEGIAVFDGEKITTTGTLWNGNKIIDERLITPDHHHHHH

SEQ ID NO: 765 - DNA, 531 bp, Artificial sequence
  Synthetic
atgaacgtgagcggctggcggctgttcaagaagattagcaacggctcgagcggtggctcgagcggtggtagctcgttcacactcgacgatttcgttggggactgggaacagacagccgcctacaacctggaccaagtccttgaacagggaggtgtgtccagtttgctgcagaatctcgccgtgtccgtaactccgatcatgaggattgtccggagcggtgaaaatgccctgaagatcgacatccatgtcatcatcccgtatgaaggtctgagcgccgaccaaatggcccagatcgaagaggtgtttaaggtggtgtaccctgtggatgatcatcactttaaggtgatcctgccctatggcacactggtaatcgacggggttacgccgaacaagctgaactatttcggacacccgtatgaaggcatcgccgtgttcgacggcgagaagatcactaccacagggaccctgtggaacggcaacaaaattatcgacgagcgcctgatcgatcccgaccatcaccatcaccatcat

SEQ ID NO: 766 - protein, 177 aa, Artificial sequence
  Synthetic
MNVSGWRLFKKISNGSSGGSSGGSSFTLDDFVGDWEQTAAYNLDQVLEQGGVSSLLQNLAVSVTPIMRIVRSGENALKIDIHVIIPYEGLSADQMAQIEEVFKVVYPVDDHHFKVILPYGTLVIDGVTPNKLNYFGHPYEGIAVFDGEKITTTGTLWNGNKIIDERLIDPDHHHHHH

SEQ ID NO: 767 - DNA, 477 bp, Artificial sequence
  Synthetic
atggtcttcacactcgaagatttcgttggggactggaagcagacagccgcctacaacctggaccaagtccttgaacagggaggtgtgtccagtttgctgcagaatctcgccgtgtccgtaactccgatccaaaggatggtccggagcggtgaaaatgccctgaagatcgacatccatgtcatcatcccgtatgaaggtctgagcgccgaccaaatggcccagatcgaagaggtgtttaaggtggtgtaccctgtggatgatcatcactttaaggtgatcctgcactatggcacactggtaatcgacggggttacgccgaacatgctgaactatttcggacggccgtatgaaggcatcgccgtgttcgacggcaaaaagatcactgtaacagggaccctgtggaacggcgccaaaattatcgacgagcgcctgatcacccccgacggctccatgtccttccaggtaaccatcaacagc

SEQ ID NO: 768 - protein, 159 aa, Artificial sequence
  Synthetic
MVFTLEDFVGDWKQTAAYNLDQVLEQGGVSSLLQNLAVSVTPIQRMVRSGENALKIDIHVIIPYEGLSADQMAQIEEVFKVVYPVDDHHFKVILHYGTLVIDGVTPNMLNYFGRPYEGIAVFDGKKITVTGTLWNGAKIIDERLITPDGSMSFQVTINS

SEQ ID NO: 769 - DNA, 477 bp, Artificial sequence; identical to SEQ ID NO: 767
  Synthetic

SEQ ID NO: 770 - protein, 159 aa, Artificial sequence; identical to SEQ ID NO: 768
  Synthetic

SEQ ID NO: 771 - DNA, 477 bp, Artificial sequence
  Synthetic
atggtcttcacactcgaagatttcgttggggactggaagcagacagccgcctacaacctggaccaagtccttgaacagggaggtgtgtccagtttgctgcagaatctcgccgtgtccgtaactccgatccaaaggatagtccggagcggtgaaaatgccctgaagatcgacatccatgtcatcatcccgtatgaaggtctgagcgccgaccaaatggcccagatcgaagaggtgtttaaggtggtgtaccctgtggatgatcatcactttaaggtgatcctgcactatggcacactggtaatcgacggggttacgccgaacatgctgaactatttcggacggccgtatgaaggcatcgccgtgttcgacggcaaaaagatcactgtaacagggaccctgtggaacggcgccaaaattatcgacgagcgcctgatcacccccgacggctccatgtccttccaggtaaccatcaacagc

SEQ ID NO: 772 - protein, 159 aa, Artificial sequence
  Synthetic
MVFTLEDFVGDWKQTAAYNLDQVLEQGGVSSLLQNLAVSVTPIQRIVRSGENALKIDIHVIIPYEGLSADQMAQIEEVFKVVYPVDDHHFKVILHYGTLVIDGVTPNMLNYFGRPYEGIAVFDGKKITVTGTLWNGAKIIDERLITPDGSMSFQVTINS

SEQ ID NO: 773 - DNA, 477 bp, Artificial sequence
  Synthetic
atggtcttcacactcgaagatttcgttggggactggaagcagacagccgcctacaacctggaccaagtccttgaacagggaggtgtgtccagtttgctgcagaatctcgccgtgtccgtaactccgatccaaagggtggtccggagcggtgaaaatgccctgaagatcgacatccatgtcatcatcccgtatgaaggtctgagcgccgaccaaatggcccagatcgaagaggtgtttaaggtggtgtaccctgtggatgatcatcactttaaggtgatcctgcactatggcacactggtaatcgacggggttacgccgaacatgctgaactatttcggacggccgtatgaaggcatcgccgtgttcgacggcaaaaagatcactgtaacagggaccctgtggaacggcgccaaaattatcgacgagcgcctgatcacccccgacggctccatgtccttccaggtaaccatcaacagc

SEQ ID NO: 774 - protein, 159 aa, Artificial sequence
  Synthetic
MVFTLEDFVGDWKQTAAYNLDQVLEQGGVSSLLQNLAVSVTPIQRVVRSGENALKIDIHVIIPYEGLSADQMAQIEEVFKVVYPVDDHHFKVILHYGTLVIDGVTPNMLNYFGRPYEGIAVFDGKKITVTGTLWNGAKIIDERLITPDGSMSFQVTINS

SEQ ID NO: 775 - DNA, 477 bp, Artificial sequence
  Synthetic
atggtcttcacactcgaagatttcgttggggactggaagcagacagccgcctacaacctggaccaagtccttgaacagggaggtgtgtccagtttgctgcagaatctcgccgtgtccgtaactccgatccaaaggtttgtccggagcggtgaaaatgccctgaagatcgacatccatgtcatcatcccgtatgaaggtctgagcgccgaccaaatggcccagatcgaagaggtgtttaaggtggtgtaccctgtggatgatcatcactttaaggtgatcctgcactatggcacactggtaatcgacggggttacgccgaacatgctgaactatttcggacggccgtatgaaggcatcgccgtgttcgacggcaaaaagatcactgtaacagggaccctgtggaacggcgccaaaattatcgacgagcgcctgatcacccccgacggctccatgtccttccaggtaaccatcaacagc

SEQ ID NO: 776 - protein, 159 aa, Artificial sequence
  Synthetic
MVFTLEDFVGDWKQTAAYNLDQVLEQGGVSSLLQNLAVSVTPIQRFVRSGENALKIDIHVIIPYEGLSADQMAQIEEVFKVVYPVDDHHFKVILHYGTLVIDGVTPNMLNYFGRPYEGIAVFDGKKITVTGTLWNGAKIIDERLITPDGSMSFQVTINS

SEQ ID NO: 777 - DNA, 477 bp, Artificial sequence
  Synthetic
atggtcttcacactcgaagatttcgttggggactggaagcagacagccgcctacaacctggaccaagtccttgaacagggaggtgtgtccagtttgctgcagaatctcgccgtgtccgtaactccgatccaaaggctggtccggagcggtgaaaatgccctgaagatcgacatccatgtcatcatcccgtatgaaggtctgagcgccgaccaaatggcccagatcgaagaggtgtttaaggtggtgtaccctgtggatgatcatcactttaaggtgatcctgcactatggcacactggtaatcgacggggttacgccgaacatgctgaactatttcggacggccgtatgaaggcatcgccgtgttcgacggcaaaaagatcactgtaacagggaccctgtggaacggcgccaaaattatcgacgagcgcctgatcacccccgacggctccatgtccttccaggtaaccatcaacagc

SEQ ID NO: 778 - protein, 159 aa, Artificial sequence
  Synthetic
MVFTLEDFVGDWKQTAAYNLDQVLEQGGVSSLLQNLAVSVTPIQRLVRSGENALKIDIHVIIPYEGLSADQMAQIEEVFKVVYPVDDHHFKVILHYGTLVIDGVTPNMLNYFGRPYEGIAVFDGKKITVTGTLWNGAKIIDERLITPDGSMSFQVTINS

SEQ ID NO: 779 - DNA, 543 bp, Artificial sequence
  Synthetic
atgaaacatcaccatcaccatcatgcgatcgccatggtcttcacactcgacgatttcgttggggactgggaacagacagccgcctacaacctggaccaagtccttgaacagggaggtgtgtccagtttgctgcagaatctcgccgtgtccgtaactccgatccaaaggattgtccggagcggtgaaaatgccctgaagatcgacatccatgtcatcatcccgtatgaaggtctgagcgccgaccaaatggcccagatcgaagaggtgtttaaggtggtgtaccctgtggatgatcatcactttaaggtgatcctgccctatggcacactggtaatcgacggggttacgccgaacaagctgaactatttcggacacccgtatgaaggcatcgccgtgttcgacggcgagaagatcactgtaacagggaccctgtggaacggcaacaaaattatcgacgagcgcctgatcacccccgacggctccatgctgttccgagtaaccatcaacggcgttagcggctggcgcctgttcaagaagatcagc

SEQ ID NO: 780 - protein, 181 aa, Artificial sequence
  Synthetic
MKHHHHHHAIAMVFTLDDFVGDWEQTAAYNLDQVLEQGGVSSLLQNLAVSVTPIQRIVRSGENALKIDIHVIIPYEGLSADQMAQIEEVFKVVYPVDDHHFKVILPYGTLVIDGVTPNKLNYFGHPYEGIAVFDGEKITVTGTLWNGNKIIDERLITPDGSMLFRVTINGVSGWRLFKKIS

SEQ ID NO: 781 - DNA, 543 bp, Artificial sequence
  Synthetic
atgaaacatcaccatcaccatcatgcgatcgccatggatttcacactcgacgatttcgttggggactgggaacagacagccgcctacaacctggaccaagtccttgaacagggaggtgtgtccagtttgctgcagaatctcgccgtgtccgtaactccgatccaaaggattgtccggagcggtgaaaatgccctgaagatcgacatccatgtcatcatcccgtatgaaggtctgagcgccgaccaaatggcccagatcgaagaggtgtttaaggtggtgtaccctgtggatgatcatcactttaaggtgatcctgccctatggcacactggtaatcgacggggttacgccgaacaagctgaactatttcggacggccgtatgaaggcatcgccgtgttcgacggcgagaagatcactgtaacagggaccctgtggaacggcaacaaaattatcgacgagcgcctgatcacccccgacggctccatgctgttccgagtaaccatcaacggcgttagcggctggcgcctgttcaagaagatcagc

SEQ ID NO: 782 - protein, 181 aa, Artificial sequence
  Synthetic
MKHHHHHHAIAMDFTLDDFVGDWEQTAAYNLDQVLEQGGVSSLLQNLAVSVTPIQRIVRSGENALKIDIHVIIPYEGLSADQMAQIEEVFKVVYPVDDHHFKVILPYGTLVIDGVTPNKLNYFGRPYEGIAVFDGEKITVTGTLWNGNKIIDERLITPDGSMLFRVTINGVSGWRLFKKIS

SEQ ID NO: 783 - DNA, 543 bp, Artificial sequence
  Synthetic
atgaaacatcaccatcaccatcatgcgatcgccatggatttcacactcgacgatttcgttggggactgggaacagacagccgcctacaacctggaccaagtccttgaacagggaggtgtgtccagtttgctgcagaatctcgccgtgtccgtaactccgatccaaaggattgtccggagcggtgaaaatgccctgaagatcgacatccatgtcatcatcccgtatgaaggtctgagcgccgaccaaatggcccagatcgaagaggtgtttaaggtggtgtaccctgtggatgatcatcactttaaggtgatcctgccctatggcacactggtaatcgacggggttacgccgaacaagctgaactatttcggacacccgtatgaaggcatcgccgtgttcgacggcaaaaagatcactgtaacagggaccctgtggaacggcaacaaaattatcgacgagcgcctgatcacccccgacggctccatgctgttccgagtaaccatcaacggcgttagcggctggcgcctgttcaagaagatcagc

SEQ ID NO: 784 - protein, 181 aa, Artificial sequence
  Synthetic
MKHHHHHHAIAMDFTLDDFVGDWEQTAAYNLDQVLEQGGVSSLLQNLAVSVTPIQRIVRSGENALKIDIHVIIPYEGLSADQMAQIEEVFKVVYPVDDHHFKVILPYGTLVIDGVTPNKLNYFGHPYEGIAVFDGKKITVTGTLWNGNKIIDERLITPDGSMLFRVTINGVSGWRLFKKIS

SEQ ID NO: 785 - DNA, 543 bp, Artificial sequence
  Synthetic
atgaaacatcaccatcaccatcatgcgatcgccatggatttcacactcgacgatttcgttggggactgggaacagacagccgcctacaacctggaccaagtccttgaacagggaggtgtgtccagtttgctgcagaatctcgccgtgtccgtaactccgatccaaaggattgtccggagcggtgaaaatgccctgaagatcgacatccatgtcatcatcccgtatgaaggtctgagcgccgaccaaatggcccagatcgaagaggtgtttaaggtggtgtaccctgtggatgatcatcactttaaggtgatcctgccctatggcacactggtaatcgacggggttacgccgaacatgctgaactatttcggacacccgtatgaaggcatcgccgtgttcgacggcgagaagatcactgtaacagggaccctgtggaacggcaacaaaattatcgacgagcgcctgatcacccccgacggctccatgctgttccgagtaaccatcaacggcgttagcggctggcgcctgttcaagaagatcagc

SEQ ID NO: 786 - protein, 181 aa, Artificial sequence
  Synthetic
MKHHHHHHAIAMDFTLDDFVGDWEQTAAYNLDQVLEQGGVSSLLQNLAVSVTPIQRIVRSGENALKIDIHVIIPYEGLSADQMAQIEEVFKVVYPVDDHHFKVILPYGTLVIDGVTPNMLNYFGHPYEGIAVFDGEKITVTGTLWNGNKIIDERLITPDGSMLFRVTINGVSGWRLFKKIS

SEQ ID NO: 787 - DNA, 543 bp, Artificial sequence
  Synthetic
atgaaacatcaccatcaccatcatgcgatcgccatggatttcacactcgaagatttcgttggggactgggaacagacagccgcctacaacctggaccaagtccttgaacagggaggtgtgtccagtttgctgcagaatctcgccgtgtccgtaactccgatccaaaggattgtccggagcggtgaaaatgccctgaagatcgacatccatgtcatcatcccgtatgaaggtctgagcgccgaccaaatggcccagatcgaagaggtgtttaaggtggtgtaccctgtggatgatcatcactttaaggtgatcctgccctatggcacactggtaatcgacggggttacgccgaacaagctgaactatttcggacacccgtatgaaggcatcgccgtgttcgacggcgagaagatcactgtaacagggaccctgtggaacggcaacaaaattatcgacgagcgcctgatcacccccgacggctccatgctgttccgagtaaccatcaacggcgttagcggctggcgcctgttcaagaagatcagc

SEQ ID NO: 788 - protein, 170 aa, Artificial sequence
  Synthetic
MVFTLDDFVGDWEQTAAYNLDQVLEQGGVSSLLQNLAVSVTPIMRIVRSGENALKIDIHVIIPYEGLSADQMAQIEEVFKVVYPVDDHHFKVILPYGTLVIDGVTPNKLNYFGRPYEGIAVFDGKKITTTGTLWNGNKIIDERLITPDGSMLFRVTINSVSGWRLFKKIS

SEQ ID NO: 789 - protein, 170 aa, Artificial sequence
  Synthetic
MVFTLDDFVGDWEQTAAYNLDQVLEQGGVSSLLQNLAVSVTPIMRIVRSGENALKIDIHVIIPYEGLSADQMAQIEEVFKVVYPVDDHHFKVILPYGTLVIDGVTPNKLNYFGRPYEGIAVFDGKKITTTGTLWNGNKIIDERLITPDGSMLFRVTINSVTGYRLFEEIL

SEQ ID NO: 790 - protein, 102 aa, Artificial sequence
  Synthetic
MVFTLDDFVGDWEQTAAYNLDQVLEQGGVSSLLQNLAVSVTPIMRIVRSGENALKIDIHVIIPYEGLSADQMAQIEEVFKVVYPVDDHHFKVILPYGTLVID

SEQ ID NO: 791 - protein, 124 aa, Artificial sequence
  Synthetic
MVFTLDDFVGDWEQTAAYNLDQVLEQGGVSSLLQNLAVSVTPIMRIVRSGENALKIDIHVIIPYEGLSADQMAQIEEVFKVVYPVDDHHFKVILPYGTLVIDGVTPNKLNYFGRPYEGIAVFDG

SEQ ID NO: 792 - protein, 133 aa, Artificial sequence
  Synthetic
MVFTLDDFVGDWEQTAAYNLDQVLEQGGVSSLLQNLAVSVTPIMRIVRSGENALKIDIHVIIPYEGLSADQMAQIEEVFKVVYPVDDHHFKVILPYGTLVIDGVTPNKLNYFGRPYEGIAVFDGKKITTTGTL

SEQ ID NO: 793 - protein, 148 aa, Artificial sequence; identical to SEQ ID NO: 302
  Synthetic

SEQ ID NO: 794 - protein, 68 aa, Artificial sequence
  Synthetic
GVTPNKLNYFGRPYEGIAVFDGKKITTTGTLWNGNKIIDERLITPDGSMLFRVTINSVSGWRLFKKIS

SEQ ID NO: 795 - protein, 46 aa, Artificial sequence
  Synthetic
KKITTTGTLWNGNKIIDERLITPDGSMLFRVTINSVSGWRLFKKIS

SEQ ID NO: 796 - protein, 37 aa, Artificial sequence
  Synthetic
WNGNKIIDERLITPDGSMLFRVTINSVSGWRLFKKIS

SEQ ID NO: 797 - protein, 22 aa, Artificial sequence
  Synthetic
GSMLFRVTINSVSGWRLFKKIS

SEQ ID NO: 798 - protein, 68 aa, Artificial sequence
  Synthetic
GVTPNKLNYFGRPYEGIAVFDGKKITTTGTLWNGNKIIDERLITPDGSMLFRVTINSVTGYRLFEEIL

SEQ ID NO: 799 - protein, 46 aa, Artificial sequence
  Synthetic
KKITTTGTLWNGNKIIDERLITPDGSMLFRVTINSVTGYRLFEEIL

SEQ ID NO: 800 - protein, 37 aa, Artificial sequence
  Synthetic
WNGNKIIDERLITPDGSMLFRVTINSVTGYRLFEEIL

SEQ ID NO: 801 - protein, 22 aa, Artificial sequence
  Synthetic
GSMLFRVTINSVTGYRLFEEIL

SEQ ID NO: 802 - protein, 181 aa, Artificial sequence
  Synthetic
MKHHHHHHAIAMDFTLEDFVGDWEQTAAYNLDQVLEQGGVSSLLQNLAVSVTPIQRIVRSGENALKIDIHVIIPYEGLSADQMAQIEEVFKVVYPVDDHHFKVILPYGTLVIDGVTPNKLNYFGHPYEGIAVFDGEKITVTGTLWNGNKIIDERLITPDGSMLFRVTINGVSGWRLFKKIS

SEQ ID NO: 803 - DNA, 543 bp, Artificial sequence
  Synthetic
atgaaacatcaccatcaccatcatgcgatcgccatggatttcacactcgacgatttcgttggggactgggaacagacagccgcctacaacctggaccaagtccttgaacagggaggtgtgtccagtttgctgcagaatctcgccgtgtccgtaactccgatccaaaggattgtccggagcggtgaaaatgccctgaagatcgacatccatgtcatcatcccgtatgaaggtctgagcgccgaccaaatggcccagatcgaagaggtgtttaaggtggtgtaccctgtggatgatcatcactttaaggtgatcctgccctatggcacactggtaatcgacggggttacgccgaacaagctgaactatttcggacacccgtatgaaggcatcgccgtgttcgacggcgagaagatcactgtaacagggaccctgtggaacggcaacaaaattatcgacgagcgcctgatcacccccgacggctccatgctgttccgagtaaccatcaacggcgttagcggctggcgcctgttcaagaagatcagc

SEQ ID NO: 804 - protein, 181 aa, Artificial sequence
  Synthetic
MKHHHHHHAIAMDFTLDDFVGDWEQTAAYNLDQVLEQGGVSSLLQNLAVSVTPIQRIVRSGENALKIDIHVIIPYEGLSADQMAQIEEVFKVVYPVDDHHFKVILPYGTLVIDGVTPNKLNYFGHPYEGIAVFDGEKITVTGTLWNGNKIIDERLITPDGSMLFRVTINGVSGWRLFKKIS

SEQ ID NO: 805 - DNA, 999 bp, Artificial sequence
  Synthetic
atgaaacatcatcaccatcaccacgcagaaatcggtactggctttccattcgacccccattatgtggaagtcctgggcgagcgcatgcactacgtcgatgttggtccgcgcgatggcacccctgtgctgttcctgcacggtaacccgacctcctcctacgtgtggcgcaacatcatcccgcatgttgcaccgacccatcgctgcattgctccagacctgatcggtatgggcaaatccgacaaaccagacctgggttatttcttcgacgaccacgtccgcttcatggatgccttcatcgaagccctgggtctggaagaggtcgtcctggtcattcacgactggggctccgctctgggtttccactgggccaagcgcaatccagagcgcgtcaaaggtattgcatttatggagttcatccgccctatcccgacctgggacgaatggccagaatttgcccgcgagaccttccaggccttccgcaccaccgacgtcggccgcaagctgatcatcgatcagaacgtttttatcgagggtacgctgccgatgggtgtcgtccgcccgctgactgaagtcgagatggaccattaccgcgagccgttcctgaatcctgttgaccgcgagccactgtggcgcttcccaaacgagctgccaatcgccggtgagccagcgaacatcgtcgcgctggtcgaagaatacatggactggctgcaccagtcccctgtcccgaagctgctgttctggggcaccccaggcgttctgatcccaccggccgaagccgctcgcctggccaaaagcctgcctaactgcaaggctgtggacatcggcccgggtctgaatctgctgcaagaagacaacccggacctgatcggcagcgagatcgcgcgctggctgtcgacgctcgagatttccggcgagccaaccactagcgataacggctccatgctgttccgagtaaccatcaacagcgttagcggctggcgcctgttcaagaagatcagc

SEQ ID NO: 806 - protein, 333 aa, Artificial sequence
  Synthetic
MKHHHHHHAEIGTGFPFDPHYVEVLGERMHYVDVGPRDGTPVLFLHGNPTSSYVWRNIIPHVAPTHRCIAPDLIGMGKSDKPDLGYFFDDHVRFMDAFIEALGLEEVVLVIHDWGSALGFHWAKRNPERVKGIAFMEFIRPIPTWDEWPEFARETFQAFRTTDVGRKLIIDQNVFIEGTLPMGVVRPLTEVEMDHYREPFLNPVDREPLWRFPNELPIAGEPANIVALVEEYMDWLHQSPVPKLLFWGTPGVLIPPAEAARLAKSLPNCKAVDIGPGLNLLQEDNPDLIGSEIARWLSTLEISGEPTTSDNGSMLFRVTINSVSGWRLFKKIS

SEQ ID NO: 807 - DNA, 543 bp, Artificial sequence
  Synthetic
atgaaacatcaccatcaccatcatgcgatcgccatggtcttcacactcgaagatttcgttggggactggaagcagacagccgcctacaacctggaccaagtccttgaacagggaggtgtgtccagtttgctgcagaatctcgccgtgtccgtaactccgatccaaaggattgtccggagcggtgaaaatgccctgaagatcgacatccatgtcatcatcccgtatgaaggtctgagcgccgaccaaatggcccagatcgaagaggtgtttaaggtggtgtaccctgtggatgatcatcactttaaggtgatcctgccctatggcacactggtaatcgacggggttacgccgaacatgctgaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacggcgttagcggctggcgcctgttcaagaagatcagc

SEQ ID NO: 808 - protein, 181 aa, Artificial sequence
  Synthetic
MKHHHHHHAIAMVFTLEDFVGDWKQTAAYNLDQVLEQGGVSSLLQNLAVSVTPIQRIVRSGENALKIDIHVIIPYEGLSADQMAQIEEVFKVVYPVDDHHFKVILPYGTLVIDGVTPNMLNYFGRPYEGIAVFDGKKITVTGTLWNGNKIIDERLITPDGSMLFRVTINGVSGWRLFKKIS

SEQ ID NO: 809 - DNA, 543 bp, Artificial sequence
  Synthetic
atgaaacatcaccatcaccatcatgcgatcgccatggtcttcacactcgaagatttcgttggggactggcgccagacagccgcctacaacctggaccaagtccttgaacagggaggtgtgtccagtttgctgcagaatctcgccgtgtccgtaactccgatccaaaggattgtccggagcggtgaaaatgccctgaagatcgacatccatgtcatcatcccgtatgaaggtctgagcgccgaccaaatggcccagatcgaagaggtgtttaaggtggtgtaccctgtggatgatcatcactttaaggtgatcctgccctatggcacactggtaatcgacggggttacgccgaacatgctgaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacggcgttagcggctggcgcctgttcaagaagatcagc

SEQ ID NO: 810 - protein, 13 aa, Artificial sequence
  Synthetic
EKMLFRVTIESWK

SEQ ID NO: 811 - protein, 13 aa, Artificial sequence
  Synthetic
EKLLFRVTIESWK

SEQ ID NO: 812 - protein, 13 aa, Artificial sequence
  Synthetic
EKLLFRVTIESYK

SEQ ID NO: 813 - protein, 181 aa, Artificial sequence
  Synthetic
MKHHHHHHAIAMVFTLEDFVGDWRQTAAYNLDQVLEQGGVSSLLQNLAVSVTPIQRIVRSGENALKIDIHVIIPYEGLSADQMAQIEEVFKVVYPVDDHHFKVILPYGTLVIDGVTPNMLNYFGRPYEGIAVFDGKKITVTGTLWNGNKIIDERLITPDGSMLFRVTINGVSGWRLFKKIS

SEQ ID NO: 814 - DNA, 543 bp, Artificial sequence
  Synthetic
atgaaacatcaccatcaccatcatgcgatcgccatggtcttcacactcgaagatttcgttggggactgggaacagacagccgcctacaacctggaccaagtccttgaacagggaggtgtgtccagtttgctgcagaatctcgccgtgtccgtaactccgatccaaaggattgtccggagcggtgaaaatgccctgaagatcgacatccatgtcatcatcccgtatgaaggtctgagcgccgaccaaatggcccagatcgaagaggtgtttaaggtggtgtaccctgtggatgatcatcactttaaggtgatcctgccctatggcacactggtaatcgacggggttacgccgaacatgctgaactatttcggacggccgttcgaaggcatcgccgtgttcgacggcaaaaagatcactgtaacagggaccctgtggaacggcaacaaaattatcgacgagcgcctgatcacccccgacggctccatgctgttccgagtaaccatcaacggcgttagcggctggcgcctgttcaagaagatcagc

SEQ ID NO: 815 - protein, 181 aa, Artificial sequence
  Synthetic
MKHHHHHHAIAMVFTLEDFVGDWEQTAAYNLDQVLEQGGVSSLLQNLAVSVTPIQRIVRSGENALKIDIHVIIPYEGLSADQMAQIEEVFKVVYPVDDHHFKVILPYGTLVIDGVTPNMLNYFGRPFEGIAVFDGKKITVTGTLWNGNKIIDERLITPDGSMLFRVTINGVSGWRLFKKIS

SEQ ID NO: 816 - protein, 13 aa, Artificial sequence
  Synthetic
DKLLFTVTIEKYK

SEQ ID NO: 817 - protein, 22 aa, Artificial sequence
  Synthetic
GVTPNKLNYFGRPYEGIAVFDG

SEQ ID NO: 818 - protein, 9 aa, Artificial sequence
  Synthetic
KKITTTGTL

SEQ ID NO: 819 - protein, 15 aa, Artificial sequence
  Synthetic
WNGNKIIDERLITPD

SEQ ID NO: 820 - DNA, 396 bp, Artificial sequence
  Synthetic
atgaaacatcaccatcaccatcatgtcttcacactcgacgatttcgttggggactgggaacagacagccgcctacaacctggaccaagtccttgaacagggaggtgtgtccagtttgctgcagaatctcgccgtgtccgtaactccgatcatgaggattgtccggagcggtgaaaatgccctgaagatcgacatccatgtcatcatcccgtatgaaggtctgagcgccgaccaaatggcccagatcgaagaggtgtttaaggtggtgtaccctgtggatgatcatcactttaaggtgatcctgccctatggcacactggtaatcgacggggttacgccgaacaagctgaactatttcggacggccgtatgaaggcatcgccgtgttcgacggctaa

SEQ ID NO: 821 - protein, 131 aa, Artificial sequence
  Synthetic
MKHHHHHHVFTLDDFVGDWEQTAAYNLDQVLEQGGVSSLLQNLAVSVTPIMRIVRSGENALKIDIHVIIPYEGLSADQMAQIEEVFKVVYPVDDHHFKVILPYGTLVIDGVTPNKLNYFGRPYEGIAVFDG

SEQ ID NO: 822 - DNA, 654 bp, Artificial sequence
  Synthetic
gggagctccggtggtggcgggagcggaggtggaggctcgagcggtatgacgtataagttaatccttaatggtaaaacattgaaaggcgagacaactactgaagctgttgatgctgctactgcagaaaaagtcttcaaacaatacgctaacgacaacggtgttgacggtgaatggacttacgacgatgcgacgaaaacctttacggtcaccgaaaaaccagaagtgatcgatgcgtctgaattaacaccagccgtgacaacttacaaacttgttattaatggtaaaacattgaaaggcgaaacaactactgaggctgttgatgctgctactgcagagaaggtgttcaaacaatatgcgaatgacaacggtgttgacggtgagtggacttacgacgatgcgactaagacctttacagttactgaaaaaccagaagtgatcgatgcgtctgagttaacaccagccgtgacaacttacaaacttgttattaatggtaaaacattgaaaggcgaaacaactactaaagcagtagacgcagaaactgcggagaaggccttcaaacaatacgctaacgacaacggtgttgatggtgtttggacttatgatgatgccacaaaaacctttacggtaactgagcatcatcaccatcaccactaa

SEQ ID NO: 823 - protein, 217 aa, Artificial sequence
  Synthetic
GSSGGGGSGGGGSSGMTYKLILNGKTLKGETTTEAVDAATAEKVFKQYANDNGVDGEWTYDDATKTFTVTEKPEVIDASELTPAVTTYKLVINGKTLKGETTTEAVDAATAEKVFKQYANDNGVDGEWTYDDATKTFTVTEKPEVIDASELTPAVTTYKLVINGKTLKGETTTKAVDAETAEKAFKQYANDNGVDGVWTYDDATKTFTVTEHHHHHH

SEQ ID NO: 824 - protein, 11 aa, Artificial sequence
  Synthetic
VSGWRLFKKIS

SEQ ID NO: 825 - protein, 10 aa, Artificial sequence
  Synthetic
VSGWRLFKKI

SEQ ID NO: 826 - protein, 13 aa, Artificial sequence
  Synthetic
VSVSGWRLFKKIS

SEQ ID NO: 827 - protein, 13 aa, Artificial sequence
  Synthetic
GKMLFRVTINSWK

SEQ ID NO: 828 - DNA, 543 bp, Artificial sequence
  Synthetic
atgaaacatcaccatcaccatcatgcgatcgccatggtcttcacactcgaagatttcgttggggactgggaacagacagccgcctacaacctggaccaagtccttgaacagggaggtgtgtccagtttgctgcagaatctcgccgtgtccgtaactccgatccaaaggattgtccggagcggtgaaaatgccctgaagatcgacatccatgtcatcatcccgtatgaaggtctgagcgccgaccaaatggcccagatcgaagaggtgtttaaggtggtgtaccctgtggatgatcatcactttaaggtgatcctgccctatggcacactggtaatcgacggggttacgccgaacatgctgaactatttcggacggccgtgggaaggcatcgccgtgttcgacggcaaaaagatcactgtaacagggaccctgtggaacggcaacaaaattatcgacgagcgcctgatcacccccgacggctccatgctgttccgagtaaccatcaacggcgttagcggctggcgcctgttcaagaagatcagc

SEQ ID NO: 829 - protein, 181 aa, Artificial sequence
  Synthetic
MKHHHHHHAIAMVFTLEDFVGDWEQTAAYNLDQVLEQGGVSSLLQNLAVSVTPIQRIVRSGENALKIDIHVIIPYEGLSADQMAQIEEVFKVVYPVDDHHFKVILPYGTLVIDGVTPNMLNYFGRPWEGIAVFDGKKITVTGTLWNGNKIIDERLITPDGSMLFRVTINGVSGWRLFKKIS

SEQ ID NO: 830 - DNA, 363 bp, Artificial sequence
  Synthetic
atgaaacatcaccatcaccatcatgtcttcacactcgacgatttcgttggggactgggaacagacagccgcctacaacctggaccaagtccttgaacagggaggtgtgtccagtttgctgcagaatctcgccgtgtccgtaactccgatcatgaggattgtccggagcggtgaaaatgccctgaagatcgacatccatgtcatcatcccgtatgaaggtctgagcgccgaccaaatggcccagatcgaagaggtgtttaaggtggtgtaccctgtggatgatcatcactttaaggtgatcctgccctatggcacactggtaatcgacggggttacgccgaacaagctgaactatttcggataa

SEQ ID NO: 831 - protein, 120 aa, Artificial sequence
  Synthetic
MKHHHHHHVFTLDDFVGDWEQTAAYNLDQVLEQGGVSSLLQNLAVSVTPIMRIVRSGENALKIDIHVIIPYEGLSADQMAQIEEVFKVVYPVDDHHFKVILPYGTLVIDGVTPNKLNYFG

SEQ ID NO: 832 - DNA, 396 bp, Artificial sequence; identical to SEQ ID NO: 820
  Synthetic

SEQ ID NO: 833 - protein, 131 aa, Artificial sequence; identical to SEQ ID NO: 821
  Synthetic

SEQ ID NO: 834 - DNA, 423 bp, Artificial sequence
  Synthetic
atgaaacatcaccatcaccatcatgtcttcacactcgacgatttcgttggggactgggaacagacagccgcctacaacctggaccaagtccttgaacagggaggtgtgtccagtttgctgcagaatctcgccgtgtccgtaactccgatcatgaggattgtccggagcggtgaaaatgccctgaagatcgacatccatgtcatcatcccgtatgaaggtctgagcgccgaccaaatggcccagatcgaagaggtgtttaaggtggtgtaccctgtggatgatcatcactttaaggtgatcctgccctatggcacactggtaatcgacggggttacgccgaacaagctgaactatttcggacggccgtatgaaggcatcgccgtgttcgacggcaaaaagatcactaccacagggaccctgtaa

SEQ ID NO: 835 - protein, 140 aa, Artificial sequence
  Synthetic
MKHHHHHHVFTLDDFVGDWEQTAAYNLDQVLEQGGVSSLLQNLAVSVTPIMRIVRSGENALKIDIHVIIPYEGLSADQMAQIEEVFKVVYPVDDHHFKVILPYGTLVIDGVTPNKLNYFGRPYEGIAVFDGKKITTTGTL

SEQ ID NO: 836 - DNA, 432 bp, Artificial sequence
  Synthetic
atgaaacatcaccatcaccatcatgtcttcacactcgacgatttcgttggggactgggaacagacagccgcctacaacctggaccaagtccttgaacagggaggtgtgtccagtttgctgcagaatctcgccgtgtccgtaactccgatcatgaggattgtccggagcggtgaaaatgccctgaagatcgacatccatgtcatcatcccgtatgaaggtctgagcgccgaccaaatggcccagatcgaagaggtgtttaaggtggtgtaccctgtggatgatcatcactttaaggtgatcctgccctatggcacactggtaatcgacggggttacgccgaacaagctgaactatttcggacggccgtatgaaggcatcgccgtgttcgacggcaaaaagatcactaccacagggaccctgtggaacggctaa

SEQ ID NO: 837 - protein, 143 aa, Artificial sequence
  Synthetic
MKHHHHHHVFTLDDFVGDWEQTAAYNLDQVLEQGGVSSLLQNLAVSVTPIMRIVRSGENALKIDIHVIIPYEGLSADQMAQIEEVFKVVYPVDDHHFKVILPYGTLVIDGVTPNKLNYFGRPYEGIAVFDGKKITTTGTLWNG

SEQ ID NO: 838 - DNA, 483 bp, Artificial sequence
  Synthetic
atggtttccgtgagcggctggcggctgttcaagaagattagcttcacactcgacgatttcgttggggactgggaacagacagccgcctacaacctggaccaagtccttgaacagggaggtgtgtccagtttgctgcagaatctcgccgtgtccgtaactccgatcatgaggattgtccggagcggtgaaaatgccctgaagatcgacatccatgtcatcatcccgtatgaaggtctgagcgccgaccaaatggcccagatcgaagaggtgtttaaggtggtgtaccctgtggatgatcatcactttaaggtgatcctgccctatggcacactggtaatcgacggggttacgccgaacaagctgaactatttcggacggccgtatgaaggcatcgccgtgttcgacggcaaaaagatcactaccacagggaccctgtggaacggcaacaaaattatcgacgagcgcctgatcacccccgactaa

SEQ ID NO: 839 - protein, 160 aa, Artificial sequence
  Synthetic
MVSVSGWRLFKKISFTLDDFVGDWEQTAAYNLDQVLEQGGVSSLLQNLAVSVTPIMRIVRSGENALKIDIHVIIPYEGLSADQMAQIEEVFKVVYPVDDHHFKVILPYGTLVIDGVTPNKLNYFGRPYEGIAVFDGKKITTTGTLWNGNKIIDERLITPD

SEQ ID NO: 840 - DNA, 495 bp, Artificial sequence
  Synthetic
atggtttccgtgagcggctggcggctgttcaagaagattagcggcagctccggtttcacactcgacgatttcgttggggactgggaacagacagccgcctacaacctggaccaagtccttgaacagggaggtgtgtccagtttgctgcagaatctcgccgtgtccgtaactccgatcatgaggattgtccggagcggtgaaaatgccctgaagatcgacatccatgtcatcatcccgtatgaaggtctgagcgccgaccaaatggcccagatcgaagaggtgtttaaggtggtgtaccctgtggatgatcatcactttaaggtgatcctgccctatggcacactggtaatcgacggggttacgccgaacaagctgaactatttcggacggccgtatgaaggcatcgccgtgttcgacggcaaaaagatcactaccacagggaccctgtggaacggcaacaaaattatcgacgagcgcctgatcacccccgactaa

SEQ ID NO: 841 - protein, 164 aa, Artificial sequence
  Synthetic
MVSVSGWRLFKKISGSSGFTLDDFVGDWEQTAAYNLDQVLEQGGVSSLLQNLAVSVTPIMRIVRSGENALKIDIHVIIPYEGLSADQMAQIEEVFKVVYPVDDHHFKVILPYGTLVIDGVTPNKLNYFGRPYEGIAVFDGKKITTTGTLWNGNKIIDERLITPD

SEQ ID NO: 842 - DNA, 507 bp, Artificial sequence
  Synthetic
atggtttccgtgagcggctggcggctgttcaagaagattagcggctcgagcggtggctcgagcggtttcacactcgacgatttcgttggggactgggaacagacagccgcctacaacctggaccaagtccttgaacagggaggtgtgtccagtttgctgcagaatctcgccgtgtccgtaactccgatcatgaggattgtccggagcggtgaaaatgccctgaagatcgacatccatgtcatcatcccgtatgaaggtctgagcgccgaccaaatggcccagatcgaagaggtgtttaaggtggtgtaccctgtggatgatcatcactttaaggtgatcctgccctatggcacactggtaatcgacggggttacgccgaacaagctgaactatttcggacggccgtatgaaggcatcgccgtgttcgacggcaaaaagatcactaccacagggaccctgtggaacggcaacaaaattatcgacgagcgcctgatcacccccgactaa

SEQ ID NO: 843 - protein, 168 aa, Artificial sequence
  Synthetic
MVSVSGWRLFKKISGSSGGSSGFTLDDFVGDWEQTAAYNLDQVLEQGGVSSLLQNLAVSVTPIMRIVRSGENALKIDIHVIIPYEGLSADQMAQIEEVFKVVYPVDDHHFKVILPYGTLVIDGVTPNKLNYFGRPYEGIAVFDGKKITTTGTLWNGNKIIDERLITPD

SEQ ID NO: 844 - DNA, 519 bp, Artificial sequence
  Synthetic
atggtttccgtgagcggctggcggctgttcaagaagattagcggctcgagcggtggctcgagcggtggctcgagcggtttcacactcgacgatttcgttggggactgggaacagacagccgcctacaacctggaccaagtccttgaacagggaggtgtgtccagtttgctgcagaatctcgccgtgtccgtaactccgatcatgaggattgtccggagcggtgaaaatgccctgaagatcgacatccatgtcatcatcccgtatgaaggtctgagcgccgaccaaatggcccagatcgaagaggtgtttaaggtggtgtaccctgtggatgatcatcactttaaggtgatcctgccctatggcacactggtaatcgacggggttacgccgaacaagctgaactatttcggacggccgtatgaaggcatcgccgtgttcgacggcaaaaagatcactaccacagggaccctgtggaacggcaacaaaattatcgacgagcgcctgatcacccccgactaa

SEQ ID NO: 845 - protein, 172 aa, Artificial sequence
  Synthetic
MVSVSGWRLFKKISGSSGGSSGGSSGFTLDDFVGDWEQTAAYNLDQVLEQGGVSSLLQNLAVSVTPIMRIVRSGENALKIDIHVIIPYEGLSADQMAQIEEVFKVVYPVDDHHFKVILPYGTLVIDGVTPNKLNYFGRPYEGIAVFDGKKITTTGTLWNGNKIIDERLITPD

SEQ ID NO: 846 - DNA, 531 bp, Artificial sequence
  Synthetic
atggtttccgtgagcggctggcggctgttcaagaagattagcggctcgagcggtggctcgagcggtggctcgagcggtggctcgagcggtttcacactcgacgatttcgttggggactgggaacagacagccgcctacaacctggaccaagtccttgaacagggaggtgtgtccagtttgctgcagaatctcgccgtgtccgtaactccgatcatgaggattgtccggagcggtgaaaatgccctgaagatcgacatccatgtcatcatcccgtatgaaggtctgagcgccgaccaaatggcccagatcgaagaggtgtttaaggtggtgtaccctgtggatgatcatcactttaaggtgatcctgccctatggcacactggtaatcgacggggttacgccgaacaagctgaactatttcggacggccgtatgaaggcatcgccgtgttcgacggcaaaaagatcactaccacagggaccctgtggaacggcaacaaaattatcgacgagcgcctgatcacccccgactaa

SEQ ID NO: 847 - protein, 176 aa, Artificial sequence
  Synthetic
MVSVSGWRLFKKISGSSGGSSGGSSGGSSGFTLDDFVGDWEQTAAYNLDQVLEQGGVSSLLQNLAVSVTPIMRIVRSGENALKIDIHVIIPYEGLSADQMAQIEEVFKVVYPVDDHHFKVILPYGTLVIDGVTPNKLNYFGRPYEGIAVFDGKKITTTGTLWNGNKIIDERLITPD

SEQ ID NO: 848 - DNA, 543 bp, Artificial sequence
  Synthetic
atggtttccgtgagcggctggcggctgttcaagaagattagcggctcgagcggtggctcgagcggtggctcgagcggtggctcgagcggtggctcgagcggtttcacactcgacgatttcgttggggactgggaacagacagccgcctacaacctggaccaagtccttgaacagggaggtgtgtccagtttgctgcagaatctcgccgtgtccgtaactccgatcatgaggattgtccggagcggtgaaaatgccctgaagatcgacatccatgtcatcatcccgtatgaaggtctgagcgccgaccaaatggcccagatcgaagaggtgtttaaggtggtgtaccctgtggatgatcatcactttaaggtgatcctgccctatggcacactggtaatcgacggggttacgccgaacaagctgaactatttcggacggccgtatgaaggcatcgccgtgttcgacggcaaaaagatcactaccacagggaccctgtggaacggcaacaaaattatcgacgagcgcctgatcacccccgactaa

SEQ ID NO: 849 - protein, 180 aa, Artificial sequence
  Synthetic
MVSVSGWRLFKKISGSSGGSSGGSSGGSSGGSSGFTLDDFVGDWEQTAAYNLDQVLEQGGVSSLLQNLAVSVTPIMRIVRSGENALKIDIHVIIPYEGLSADQMAQIEEVFKVVYPVDDHHFKVILPYGTLVIDGVTPNKLNYFGRPYEGIAVFDGKKITTTGTLWNGNKIIDERLITPD

SEQ ID NO: 850 - DNA, 537 bp, Artificial sequence
  Synthetic
atggtgagcggctggcggctgttcaagaagattagcggctcgagcggtggctcgagcggtggctcgagcggtggctcgagcggtggctcgagcggtttcacactcgacgatttcgttggggactgggaacagacagccgcctacaacctggaccaagtccttgaacagggaggtgtgtccagtttgctgcagaatctcgccgtgtccgtaactccgatcatgaggattgtccggagcggtgaaaatgccctgaagatcgacatccatgtcatcatcccgtatgaaggtctgagcgccgaccaaatggcccagatcgaagaggtgtttaaggtggtgtaccctgtggatgatcatcactttaaggtgatcctgccctatggcacactggtaatcgacggggttacgccgaacaagctgaactatttcggacggccgtatgaaggcatcgccgtgttcgacggcaaaaagatcactaccacagggaccctgtggaacggcaacaaaattatcgacgagcgcctgatcacccccgactaa

SEQ ID NO: 851 - protein, 178 aa, Artificial sequence
  Synthetic
MVSGWRLFKKISGSSGGSSGGSSGGSSGGSSGFTLDDFVGDWEQTAAYNLDQVLEQGGVSSLLQNLAVSVTPIMRIVRSGENALKIDIHVIIPYEGLSADQMAQIEEVFKVVYPVDDHHFKVILPYGTLVIDGVTPNKLNYFGRPYEGIAVFDGKKITTTGTLWNGNKIIDERLITPD

SEQ ID NO: 852 - DNA, 486 bp, Artificial sequence
  Synthetic
atggtcttcacactcgacgatttcgttggggactgggaacagacagccgcctacaacctggaccaagtccttgaacagggaggtgtgtccagtttgctgcagaatctcgccgtgtccgtaactccgatcatgaggattgtccggagcggtgaaaatgccctgaagatcgacatccatgtcatcatcccgtatgaaggtctgagcgccgaccaaatggcccagatcgaagaggtgtttaaggtggtgtaccctgtggatgatcatcactttaaggtgatcctgccctatggcacactggtaatcgacggggttacgccgaacaagctgaactatttcggacggccgtatgaaggcatcgccgtgttcgacggcaaaaagatcactaccacagggaccctgtggaacggcaacaaaattatcgacgagcgcctgatcacccccgacgtttccgtgagcggctggcggctgttcaagaagattagctaa

SEQ ID NO: 853 - protein, 161 aa, Artificial sequence
  Synthetic
MVFTLDDFVGDWEQTAAYNLDQVLEQGGVSSLLQNLAVSVTPIMRIVRSGENALKIDIHVIIPYEGLSADQMAQIEEVFKVVYPVDDHHFKVILPYGTLVIDGVTPNKLNYFGRPYEGIAVFDGKKITTTGTLWNGNKIIDERLITPDVSVSGWRLFKKIS

SEQ ID NO: 854 - DNA, 498 bp, Artificial sequence
  Synthetic
atggtcttcacactcgacgatttcgttggggactgggaacagacagccgcctacaacctggaccaagtccttgaacagggaggtgtgtccagtttgctgcagaatctcgccgtgtccgtaactccgatcatgaggattgtccggagcggtgaaaatgccctgaagatcgacatccatgtcatcatcccgtatgaaggtctgagcgccgaccaaatggcccagatcgaagaggtgtttaaggtggtgtaccctgtggatgatcatcactttaaggtgatcctgccctatggcacactggtaatcgacggggttacgccgaacaagctgaactatttcggacggccgtatgaaggcatcgccgtgttcgacggcaaaaagatcactaccacagggaccctgtggaacggcaacaaaattatcgacgagcgcctgatcacccccgacggctcgagcggtgtttccgtgagcggctggcggctgttcaagaagattagctaa

SEQ ID NO: 855 - protein, 165 aa, Artificial sequence
  Synthetic
MVFTLDDFVGDWEQTAAYNLDQVLEQGGVSSLLQNLAVSVTPIMRIVRSGENALKIDIHVIIPYEGLSADQMAQIEEVFKVVYPVDDHHFKVILPYGTLVIDGVTPNKLNYFGRPYEGIAVFDGKKITTTGTLWNGNKIIDERLITPDGSSGVSVSGWRLFKKIS

SEQ ID NO: 856 - DNA, 510 bp, Artificial sequence
  Synthetic
atggtcttcacactcgacgatttcgttggggactgggaacagacagccgcctacaacctggaccaagtccttgaacagggaggtgtgtccagtttgctgcagaatctcgccgtgtccgtaactccgatcatgaggattgtccggagcggtgaaaatgccctgaagatcgacatccatgtcatcatcccgtatgaaggtctgagcgccgaccaaatggcccagatcgaagaggtgtttaaggtggtgtaccctgtggatgatcatcactttaaggtgatcctgccctatggcacactggtaatcgacggggttacgccgaacaagctgaactatttcggacggccgtatgaaggcatcgccgtgttcgacggcaaaaagatcactaccacagggaccctgtggaacggcaacaaaattatcgacgagcgcctgatcacccccgacggctcgagcggtggctcgagcggtgtttccgtgagcggctggcggctgttcaagaagattagctaa

SEQ ID NO: 857 - protein, 169 aa, Artificial sequence
  Synthetic
MVFTLDDFVGDWEQTAAYNLDQVLEQGGVSSLLQNLAVSVTPIMRIVRSGENALKIDIHVIIPYEGLSADQMAQIEEVFKVVYPVDDHHFKVILPYGTLVIDGVTPNKLNYFGRPYEGIAVFDGKKITTTGTLWNGNKIIDERLITPDGSSGGSSGVSVSGWRLFKKIS

SEQ ID NO: 858 - DNA, 504 bp, Artificial sequence
  Synthetic
atggtcttcacactcgacgatttcgttggggactgggaacagacagccgcctacaacctggaccaagtccttgaacagggaggtgtgtccagtttgctgcagaatctcgccgtgtccgtaactccgatcatgaggattgtccggagcggtgaaaatgccctgaagatcgacatccatgtcatcatcccgtatgaaggtctgagcgccgaccaaatggcccagatcgaagaggtgtttaaggtggtgtaccctgtggatgatcatcactttaaggtgatcctgccctatggcacactggtaatcgacggggttacgccgaacaagctgaactatttcggacggccgtatgaaggcatcgccgtgttcgacggcaaaaagatcactaccacagggaccctgtggaacggcaacaaaattatcgacgagcgcctgatcacccccgacggctcgagcggtggctcgagcggtgtgagcggctggcggctgttcaagaagattagctaa

SEQ ID NO: 859 - protein, 167 aa, Artificial sequence
  Synthetic
MVFTLDDFVGDWEQTAAYNLDQVLEQGGVSSLLQNLAVSVTPIMRIVRSGENALKIDIHVIIPYEGLSADQMAQIEEVFKVVYPVDDHHFKVILPYGTLVIDGVTPNKLNYFGRPYEGIAVFDGKKITTTGTLWNGNKIIDERLITPDGSSGGSSGVSGWRLFKKIS

SEQ ID NO: 860 - DNA, 501 bp, Artificial sequence
  Synthetic
atggtttccgtgagcggctggcggctgttcaagaagattagcttcacactcgacgatttcgttggggactgggaacagacagccgcctacaacctggaccaagtccttgaacagggaggtgtgtccagtttgctgcagaatctcgccgtgtccgtaactccgatcatgaggattgtccggagcggtgaaaatgccctgaagatcgacatccatgtcatcatcccgtatgaaggtctgagcgccgaccaaatggcccagatcgaagaggtgtttaaggtggtgtaccctgtggatgatcatcactttaaggtgatcctgccctatggcacactggtaatcgacggggttacgccgaacaagctgaactatttcggacggccgtatgaaggcatcgccgtgttcgacggcaaaaagatcactaccacagggaccctgtggaacggcaacaaaattatcgacgagcgcctgatcacccccgaccatcaccatcaccatcattaa

SEQ ID NO: 861 - protein, 166 aa, Artificial sequence
  Synthetic
MVSVSGWRLFKKISFTLDDFVGDWEQTAAYNLDQVLEQGGVSSLLQNLAVSVTPIMRIVRSGENALKIDIHVIIPYEGLSADQMAQIEEVFKVVYPVDDHHFKVILPYGTLVIDGVTPNKLNYFGRPYEGIAVFDGKKITTTGTLWNGNKIIDERLITPDHHHHHH

SEQ ID NO: 862 - DNA, 513 bp, Artificial sequence
  Synthetic
atggtttccgtgagcggctggcggctgttcaagaagattagcggcagctccggtttcacactcgacgatttcgttggggactgggaacagacagccgcctacaacctggaccaagtccttgaacagggaggtgtgtccagtttgctgcagaatctcgccgtgtccgtaactccgatcatgaggattgtccggagcggtgaaaatgccctgaagatcgacatccatgtcatcatcccgtatgaaggtctgagcgccgaccaaatggcccagatcgaagaggtgtttaaggtggtgtaccctgtggatgatcatcactttaaggtgatcctgccctatggcacactggtaatcgacggggttacgccgaacaagctgaactatttcggacggccgtatgaaggcatcgccgtgttcgacggcaaaaagatcactaccacagggaccctgtggaacggcaacaaaattatcgacgagcgcctgatcacccccgaccatcaccatcaccatcattaa

SEQ ID NO: 863 - protein, 170 aa, Artificial sequence
  Synthetic
MVSVSGWRLFKKISGSSGFTLDDFVGDWEQTAAYNLDQVLEQGGVSSLLQNLAVSVTPIMRIVRSGENALKIDIHVIIPYEGLSADQMAQIEEVFKVVYPVDDHHFKVILPYGTLVIDGVTPNKLNYFGRPYEGIAVFDGKKITTTGTLWNGNKIIDERLITPDHHHHHH

SEQ ID NO: 864 - DNA, 525 bp, Artificial sequence
  Synthetic
atggtttccgtgagcggctggcggctgttcaagaagattagcggctcgagcggtggctcgagcggtttcacactcgacgatttcgttggggactgggaacagacagccgcctacaacctggaccaagtccttgaacagggaggtgtgtccagtttgctgcagaatctcgccgtgtccgtaactccgatcatgaggattgtccggagcggtgaaaatgccctgaagatcgacatccatgtcatcatcccgtatgaaggtctgagcgccgaccaaatggcccagatcgaagaggtgtttaaggtggtgtaccctgtggatgatcatcactttaaggtgatcctgccctatggcacactggtaatcgacggggttacgccgaacaagctgaactatttcggacggccgtatgaaggcatcgccgtgttcgacggcaaaaagatcactaccacagggaccctgtggaacggcaacaaaattatcgacgagcgcctgatcacccccgaccatcaccatcaccatcattaa

SEQ ID NO: 865 - protein, 174 aa, Artificial sequence
  Synthetic
MVSVSGWRLFKKISGSSGGSSGFTLDDFVGDWEQTAAYNLDQVLEQGGVSSLLQNLAVSVTPIMRIVRSGENALKIDIHVIIPYEGLSADQMAQIEEVFKVVYPVDDHHFKVILPYGTLVIDGVTPNKLNYFGRPYEGIAVFDGKKITTTGTLWNGNKIIDERLITPDHHHHHH

SEQ ID NO: 866 - DNA, 537 bp, Artificial sequence
  Synthetic
atggtttccgtgagcggctggcggctgttcaagaagattagcggctcgagcggtggctcgagcggtggctcgagcggtttcacactcgacgatttcgttggggactgggaacagacagccgcctacaacctggaccaagtccttgaacagggaggtgtgtccagtttgctgcagaatctcgccgtgtccgtaactccgatcatgaggattgtccggagcggtgaaaatgccctgaagatcgacatccatgtcatcatcccgtatgaaggtctgagcgccgaccaaatggcccagatcgaagaggtgtttaaggtggtgtaccctgtggatgatcatcactttaaggtgatcctgccctatggcacactggtaatcgacggggttacgccgaacaagctgaactatttcggacggccgtatgaaggcatcgccgtgttcgacggcaaaaagatcactaccacagggaccctgtggaacggcaacaaaattatcgacgagcgcctgatcacccccgaccatcaccatcaccatcattaa

SEQ ID NO: 867 - protein, 178 aa, Artificial sequence
  Synthetic
MVSVSGWRLFKKISGSSGGSSGGSSGFTLDDFVGDWEQTAAYNLDQVLEQGGVSSLLQNLAVSVTPIMRIVRSGENALKIDIHVIIPYEGLSADQMAQIEEVFKVVYPVDDHHFKVILPYGTLVIDGVTPNKLNYFGRPYEGIAVFDGKKITTTGTLWNGNKIIDERLITPDHHHHHH

SEQ ID NO: 868 - DNA, 549 bp, Artificial sequence
  Synthetic
atggtttccgtgagcggctggcggctgttcaagaagattagcggctcgagcggtggctcgagcggtggctcgagcggtggctcgagcggtttcacactcgacgatttcgttggggactgggaacagacagccgcctacaacctggaccaagtccttgaacagggaggtgtgtccagtttgctgcagaatctcgccgtgtccgtaactccgatcatgaggattgtccggagcggtgaaaatgccctgaagatcgacatccatgtcatcatcccgtatgaaggtctgagcgccgaccaaatggcccagatcgaagaggtgtttaaggtggtgtaccctgtggatgatcatcactttaaggtgatcctgccctatggcacactggtaatcgacggggttacgccgaacaagctgaactatttcggacggccgtatgaaggcatcgccgtgttcgacggcaaaaagatcactaccacagggaccctgtggaacggcaacaaaattatcgacgagcgcctgatcacccccgaccatcaccatcaccatcattaa

SEQ ID NO: 869 - protein, 182 aa, Artificial sequence
  Synthetic
MVSVSGWRLFKKISGSSGGSSGGSSGGSSGFTLDDFVGDWEQTAAYNLDQVLEQGGVSSLLQNLAVSVTPIMRIVRSGENALKIDIHVIIPYEGLSADQMAQIEEVFKVVYPVDDHHFKVILPYGTLVIDGVTPNKLNYFGRPYEGIAVFDGKKITTTGTLWNGNKIIDERLITPDHHHHHH

SEQ ID NO: 870 - DNA, 555 bp, Artificial sequence
  Synthetic
atggtgagcggctggcggctgttcaagaagattagcggctcgagcggtggctcgagcggtggctcgagcggtggctcgagcggtggctcgagcggtttcacactcgacgatttcgttggggactgggaacagacagccgcctacaacctggaccaagtccttgaacagggaggtgtgtccagtttgctgcagaatctcgccgtgtccgtaactccgatcatgaggattgtccggagcggtgaaaatgccctgaagatcgacatccatgtcatcatcccgtatgaaggtctgagcgccgaccaaatggcccagatcgaagaggtgtttaaggtggtgtaccctgtggatgatcatcactttaaggtgatcctgccctatggcacactggtaatcgacggggttacgccgaacaagctgaactatttcggacggccgtatgaaggcatcgccgtgttcgacggcaaaaagatcactaccacagggaccctgtggaacggcaacaaaattatcgacgagcgcctgatcacccccgaccatcaccatcaccatcattaa

SEQ ID NO: 871 - protein, 184 aa, Artificial sequence
  Synthetic
MVSGWRLFKKISGSSGGSSGGSSGGSSGGSSGFTLDDFVGDWEQTAAYNLDQVLEQGGVSSLLQNLAVSVTPIMRIVRSGENALKIDIHVIIPYEGLSADQMAQIEEVFKVVYPVDDHHFKVILPYGTLVIDGVTPNKLNYFGRPYEGIAVFDGKKITTTGTLWNGNKIIDERLITPDHHHHHH

SEQ ID NO: 872 - DNA, 561 bp, Artificial sequence
  Synthetic
atggtttccgtgagcggctggcggctgttcaagaagattagcggctcgagcggtggctcgagcggtggctcgagcggtggctcgagcggtggctcgagcggtttcacactcgacgatttcgttggggactgggaacagacagccgcctacaacctggaccaagtccttgaacagggaggtgtgtccagtttgctgcagaatctcgccgtgtccgtaactccgatcatgaggattgtccggagcggtgaaaatgccctgaagatcgacatccatgtcatcatcccgtatgaaggtctgagcgccgaccaaatggcccagatcgaagaggtgtttaaggtggtgtaccctgtggatgatcatcactttaaggtgatcctgccctatggcacactggtaatcgacggggttacgccgaacaagctgaactatttcggacggccgtatgaaggcatcgccgtgttcgacggcaaaaagatcactaccacagggaccctgtggaacggcaacaaaattatcgacgagcgcctgatcacccccgaccatcaccatcaccatcattaa

SEQ ID NO: 873 - protein, 186 aa, Artificial sequence
  Synthetic
MVSVSGWRLFKKISGSSGGSSGGSSGGSSGGSSGFTLDDFVGDWEQTAAYNLDQVLEQGGVSSLLQNLAVSVTPIMRIVRSGENALKIDIHVIIPYEGLSADQMAQIEEVFKVVYPVDDHHFKVILPYGTLVIDGVTPNKLNYFGRPYEGIAVFDGKKITTTGTLWNGNKIIDERLITPDHHHHHH

SEQ ID NO: 874 - DNA, 507 bp, Artificial sequence
  Synthetic
atgaaacatcaccatcaccatcatgtcttcacactcgacgatttcgttggggactgggaacagacagccgcctacaacctggaccaagtccttgaacagggaggtgtgtccagtttgctgcagaatctcgccgtgtccgtaactccgatcatgaggattgtccggagcggtgaaaatgccctgaagatcgacatccatgtcatcatcccgtatgaaggtctgagcgccgaccaaatggcccagatcgaagaggtgtttaaggtggtgtaccctgtggatgatcatcactttaaggtgatcctgccctatggcacactggtaatcgacggggttacgccgaacaagctgaactatttcggacggccgtatgaaggcatcgccgtgttcgacggcaaaaagatcactaccacagggaccctgtggaacggcaacaaaattatcgacgagcgcctgatcacccccgacgtttccgtgagcggctggcggctgttcaagaagattagctaa

SEQ ID NO: 875 - protein, 168 aa, Artificial sequence
  Synthetic
MKHHHHHHVFTLDDFVGDWEQTAAYNLDQVLEQGGVSSLLQNLAVSVTPIMRIVRSGENALKIDIHVIIPYEGLSADQMAQIEEVFKVVYPVDDHHFKVILPYGTLVIDGVTPNKLNYFGRPYEGIAVFDGKKITTTGTLWNGNKIIDERLITPDVSVSGWRLFKKIS

SEQ ID NO: 876 - DNA, 519 bp, Artificial sequence
  Synthetic
atgaaacatcaccatcaccatcatgtcttcacactcgacgatttcgttggggactgggaacagacagccgcctacaacctggaccaagtccttgaacagggaggtgtgtccagtttgctgcagaatctcgccgtgtccgtaactccgatcatgaggattgtccggagcggtgaaaatgccctgaagatcgacatccatgtcatcatcccgtatgaaggtctgagcgccgaccaaatggcccagatcgaagaggtgtttaaggtggtgtaccctgtggatgatcatcactttaaggtgatcctgccctatggcacactggtaatcgacggggttacgccgaacaagctgaactatttcggacggccgtatgaaggcatcgccgtgttcgacggcaaaaagatcactaccacagggaccctgtggaacggcaacaaaattatcgacgagcgcctgatcacccccgacggctcgagcggtgtttccgtgagcggctggcggctgttcaagaagattagctaa

SEQ ID NO: 877 - protein, 172 aa, Artificial sequence
  Synthetic
MKHHHHHHVFTLDDFVGDWEQTAAYNLDQVLEQGGVSSLLQNLAVSVTPIMRIVRSGENALKIDIHVIIPYEGLSADQMAQIEEVFKVVYPVDDHHFKVILPYGTLVIDGVTPNKLNYFGRPYEGIAVFDGKKITTTGTLWNGNKIIDERLITPDGSSGVSVSGWRLFKKIS

SEQ ID NO: 878 - DNA, 525 bp, Artificial sequence
  Synthetic
atgaaacatcaccatcaccatcatgtcttcacactcgacgatttcgttggggactgggaacagacagccgcctacaacctggaccaagtccttgaacagggaggtgtgtccagtttgctgcagaatctcgccgtgtccgtaactccgatcatgaggattgtccggagcggtgaaaatgccctgaagatcgacatccatgtcatcatcccgtatgaaggtctgagcgccgaccaaatggcccagatcgaagaggtgtttaaggtggtgtaccctgtggatgatcatcactttaaggtgatcctgccctatggcacactggtaatcgacggggttacgccgaacaagctgaactatttcggacggccgtatgaaggcatcgccgtgttcgacggcaaaaagatcactaccacagggaccctgtggaacggcaacaaaattatcgacgagcgcctgatcacccccgacggctcgagcggtggctcgagcggtgtgagcggctggcggctgttcaagaagattagctaa

SEQ ID NO: 879 - protein, 174 aa, Artificial sequence
  Synthetic
MKHHHHHHVFTLDDFVGDWEQTAAYNLDQVLEQGGVSSLLQNLAVSVTPIMRIVRSGENALKIDIHVIIPYEGLSADQMAQIEEVFKVVYPVDDHHFKVILPYGTLVIDGVTPNKLNYFGRPYEGIAVFDGKKITTTGTLWNGNKIIDERLITPDGSSGGSSGVSGWRLFKKIS

SEQ ID NO: 880 - DNA, 531 bp, Artificial sequence
  Synthetic
atgaaacatcaccatcaccatcatgtcttcacactcgacgatttcgttggggactgggaacagacagccgcctacaacctggaccaagtccttgaacagggaggtgtgtccagtttgctgcagaatctcgccgtgtccgtaactccgatcatgaggattgtccggagcggtgaaaatgccctgaagatcgacatccatgtcatcatcccgtatgaaggtctgagcgccgaccaaatggcccagatcgaagaggtgtttaaggtggtgtaccctgtggatgatcatcactttaaggtgatcctgccctatggcacactggtaatcgacggggttacgccgaacaagctgaactatttcggacggccgtatgaaggcatcgccgtgttcgacggcaaaaagatcactaccacagggaccctgtggaacggcaacaaaattatcgacgagcgcctgatcacccccgacggctcgagcggtggctcgagcggtgtttccgtgagcggctggcggctgttcaagaagattagctaa

SEQ ID NO: 881 - protein, 176 aa, Artificial sequence
  Synthetic
MKHHHHHHVFTLDDFVGDWEQTAAYNLDQVLEQGGVSSLLQNLAVSVTPIMRIVRSGENALKIDIHVIIPYEGLSADQMAQIEEVFKVVYPVDDHHFKVILPYGTLVIDGVTPNKLNYFGRPYEGIAVFDGKKITTTGTLWNGNKIIDERLITPDGSSGGSSGVSVSGWRLFKKIS

SEQ ID NO: 882 - DNA, 498 bp, Artificial sequence; identical to SEQ ID NO: 116
  Synthetic

SEQ ID NO: 883 - protein, 165 aa, Artificial sequence; identical to SEQ ID NO: 11
  Synthetic

SEQ ID NO: 884 - DNA, 501 bp, Artificial sequence; identical to SEQ ID NO: 210
  Synthetic

SEQ ID NO: 885 - protein, 166 aa, Artificial sequence; identical to SEQ ID NO: 211
  Synthetic

SEQ ID NO: 886 - DNA, 510 bp, Artificial sequence; identical to SEQ ID NO: 212
  Synthetic

SEQ ID NO: 887 - protein, 169 aa, Artificial sequence; identical to SEQ ID NO: 213
  Synthetic

SEQ ID NO: 888 - DNA, 507 bp, Artificial sequence
  Synthetic
atggtgagcggctggcggctgttcaagaagattagcggcagctccggtttcacactcgacgatttcgttggggactgggaacagacagccgcctacaacctggaccaagtccttgaacagggaggtgtgtccagtttgctgcagaatctcgccgtgtccgtaactccgatcatgaggattgtccggagcggtgaaaatgccctgaagatcgacatccatgtcatcatcccgtatgaaggtctgagcgccgaccaaatggcccagatcgaagaggtgtttaaggtggtgtaccctgtggatgatcatcactttaaggtgatcctgccctatggcacactggtaatcgacggggttacgccgaacaagctgaactatttcggacggccgtatgaaggcatcgccgtgttcgacggcaaaaagatcactaccacagggaccctgtggaacggcaacaaaattatcgacgagcgcctgatcacccccgaccatcaccatcaccatcattaa

SEQ ID NO: 889 - protein, 168 aa, Artificial sequence
  Synthetic
MVSGWRLFKKISGSSGFTLDDFVGDWEQTAAYNLDQVLEQGGVSSLLQNLAVSVTPIMRIVRSGENALKIDIHVIIPYEGLSADQMAQIEEVFKVVYPVDDHHFKVILPYGTLVIDGVTPNKLNYFGRPYEGIAVFDGKKITTTGTLWNGNKIIDERLITPDHHHHHH

SEQ ID NO: 890 - DNA, 498 bp, Artificial sequence
  Synthetic
atggtcttcacactcgaagatttcgttggggactgggaacagacagccgcctacaacctggaccaagtccttgaacagggaggtgtgtccagtttgctgcagaatctcgccgtgtccgtaactccgatccaaaggattgtccggagcggtgaaaatgccctgaagatcgacatccatgtcatcatcccgtatgaaggtctgagcgccgaccaaatggcccagatcgaagaggtgtttaaggtggtgtaccctgtggatgatcatcactttaaggtgatcctgccctatggcacactggtaatcgacggggttacgccgaacatgctgaactatttcggacggccgtatgaaggcatcgccgtgttcgacggcaaaaagatcactgtaacagggaccctgtggaacgagaacaaaattatcgacgagcgcctgatcacccccgacggctccatgctgttccgagtaaccatcaacagccatcatcaccatcaccactaa

SEQ ID NO: 891 - protein, 165 aa, Artificial sequence
  Synthetic
MVFTLEDFVGDWEQTAAYNLDQVLEQGGVSSLLQNLAVSVTPIQRIVRSGENALKIDIHVIIPYEGLSADQMAQIEEVFKVVYPVDDHHFKVILPYGTLVIDGVTPNMLNYFGRPYEGIAVFDGKKITVTGTLWNENKIIDERLITPDGSMLFRVTINSHHHHHH

SEQ ID NO: 892 - DNA, 498 bp, Artificial sequence
  Synthetic
atggtcttcacactcgaagatttcgttggggactgggaacagacagccgcctacaacctggaccaagtccttgaacagggaggtgtgtccagtttgctgcagaatctcgccgtgtccgtaactccgatccaaaggattgtccggagcggtgaaaatgccctgaagatcgacatccatgtcatcatcccgtatgaaggtctgagcgccgaccaaatggcccagatcgaagaggtgtttaaggtggtgtaccctgtggatgatcatcactttaaggtgatcctgccctatggcacactggtaatcgacggggttacgccgaacatgctgaactatttcggacggccgtatgaaggcatcgccgtgttcgacggcaaaaagatcactgtaacagggaccctgtggaacggcgttaaaattatcgacgagcgcctgatcacccccgacggctccatgctgttccgagtaaccatcaacagccatcatcaccatcaccactaa

SEQ ID NO: 893 - protein, 165 aa, Artificial sequence
  Synthetic
MVFTLEDFVGDWEQTAAYNLDQVLEQGGVSSLLQNLAVSVTPIQRIVRSGENALKIDIHVIIPYEGLSADQMAQIEEVFKVVYPVDDHHFKVILPYGTLVIDGVTPNMLNYFGRPYEGIAVFDGKKITVTGTLWNGVKIIDERLITPDGSMLFRVTINSHHHHHH

SEQ ID NO: 894 - DNA, 498 bp, Artificial sequence
  Synthetic
atggtcttcacactcgaagatttcgttggggactgggaacagacagccgcctacaacctggaccaagtccttgaacagggaggtgtgtccagtttgctgcagaatctcgccgtgtccgtaactccgatccaaaggatggtccggagcggtgaaaatgccctgaagatcgacatccatgtcatcatcccgtatgaaggtctgagcgccgaccaaatggcccagatcgaagaggtgtttaaggtggtgtaccctgtggatgatcatcactttaaggtgatcctgccctatggcacactggtaatcgacggggttacgccgaacatgctgaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacagccatcatcaccatcaccactaa

SEQ ID NO: 895 - protein, 165 aa, Artificial sequence
  Synthetic
MVFTLEDFVGDWEQTAAYNLDQVLEQGGVSSLLQNLAVSVTPIQRMVRSGENALKIDIHVIIPYEGLSADQMAQIEEVFKVVYPVDDHHFKVILPYGTLVIDGVTPNMLNYFGRPYEGIAVFDGKKITVTGTLWNGNKIIDERLITPDGSMLFRVTINSHHHHHH

SEQ ID NO: 896 - DNA, 498 bp, Artificial sequence
  Synthetic
atggtcttcacactcgaagatttcgttggggactggaagcagacagccgcctacaacctggaccaagtccttgaacagggaggtgtgtccagtttgctgcagaatctcgccgtgtccgtaactccgatccaaaggatggtccggagcggtgaaaatgccctgaagatcgacatccatgtcatcatcccgtatgaaggtctgagcgccgaccaaatggcccagatcgaagaggtgtttaaggtggtgtaccctgtggatgatcatcactttaaggtgatcctgccctatggcacactggtaatcgacggggttacgccgaacatgctgaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacagccatcatcaccatcaccactaa

SEQ ID NO: 897 - protein, 165 aa, Artificial sequence
  Synthetic
MVFTLEDFVGDWKQTAAYNLDQVLEQGGVSSLLQNLAVSVTPIQRMVRSGENALKIDIHVIIPYEGLSADQMAQIEEVFKVVYPVDDHHFKVILPYGTLVIDGVTPNMLNYFGRPYEGIAVFDGKKITVTGTLWNGNKIIDERLITPDGSMLFRVTINSHHHHHH

SEQ ID NO: 898 - DNA, 498 bp, Artificial sequence
  Synthetic
atggtcttcacactcgaagatttcgttggggactggaagcagacagccgcctacaacctggaccaagtccttgaacagggaggtgtgtccagtttgctgcagaatctcgccgtgtccgtaactccgatccaaaggatggtccggagcggtgaaaatgccctgaagatcgacatccatgtcatcatcccgtatgaaggtctgagcgccgaccaaatggcccagatcgaagaggtgtttaaggtggtgtaccctgtggatgatcatcactttaaggtgatcctgccctatggcacactggtaatcgacggggttacgccgaacatgctgaactatttcggacggccgtatgaaggcatcgccgtgttcgacggcaaaaagatcactgtaacagggaccctgtggaacgacgtcaaaattatcgacgagcgcctgatcacccccgacggctccatgctgttccgagtaaccatcaacagccatcatcaccatcaccactaa

SEQ ID NO: 899 - protein, 165 aa, Artificial sequence
  Synthetic
MVFTLEDFVGDWKQTAAYNLDQVLEQGGVSSLLQNLAVSVTPIQRMVRSGENALKIDIHVIIPYEGLSADQMAQIEEVFKVVYPVDDHHFKVILPYGTLVIDGVTPNMLNYFGRPYEGIAVFDGKKITVTGTLWNDVKIIDERLITPDGSMLFRVTINSHHHHHH

SEQ ID NO: 900 - protein, 13 aa, Artificial sequence
  Synthetic
GRMLFRVTINSWR

SEQ ID NO: 901 - protein, 11 aa, Artificial sequence
  Synthetic
VSGWRLFRRIS

SEQ ID NO: 902 - protein, 13 aa, Artificial sequence
  Synthetic
GRLLFVVVIERYR

SEQ ID NO: 903 - protein, 12 aa, Artificial sequence
  Synthetic
VSGWRLFRRISC

SEQ ID NO: 904 - protein, 14 aa, Artificial sequence
  Synthetic
GRMLFRVTINSWRC

SEQ ID NO: 905 - protein, 14 aa, Artificial sequence
  Synthetic
GRLLFTVTIERYRC

SEQ ID NO: 906 - protein, 13 aa, Artificial sequence
  Synthetic
GKLLFVVVIEKYK

SEQ ID NO: 907 - protein, 21 aa, Artificial sequence
  Synthetic
GKLLFVTIEKVSGWRLFKKIS

SEQ ID NO: 908 - DNA, 468 bp, Artificial sequence
  Synthetic
atgaaacatcaccatcaccatcatgtcttcacactcgacgatttcgttggggactgggaacagacagccgcctacaacctggaccaagtccttgaacagggaggtgtgtccagtttgctgcagaatctcgccgtgtccgtaactccgatcatgaggattgtccggagcggtgaaaatgccctgaagatcgacatccatgtcatcatcccgtatgaaggtctgagcgccgaccaaatggcccagatcgaagaggtgtttaaggtggtgtaccctgtggatgatcatcactttaaggtgatcctgccctatggcacactggtaatcgacggggttacgccgaacaagctgaactatttcggacacccgtatgaaggcatcgccgtgttcgacggcaaaaagatcactaccacagggaccctgtggaacggcaacaaaattatcgacgagcgcctgatcacccccgactaa

SEQ ID NO: 909 - protein, 155 aa, Artificial sequence
  Synthetic
MKHHHHHHVFTLDDFVGDWEQTAAYNLDQVLEQGGVSSLLQNLAVSVTPIMRIVRSGENALKIDIHVIIPYEGLSADQMAQIEEVFKVVYPVDDHHFKVILPYGTLVIDGVTPNKLNYFGHPYEGIAVFDGKKITTTGTLWNGNKIIDERLITPD

SEQ ID NO: 910 - DNA, 468 bp, Artificial sequence
  Synthetic
atgaaacatcaccatcaccatcatgtcttcacactcgacgatttcgttggggactgggaacagacagccgcctacaacctggaccaagtccttgaacagggaggtgtgtccagtttgctgcagaatctcgccgtgtccgtaactccgatcatgaggattgtccggagcggtgaaaatgccctgaagatcgacatccatgtcatcatcccgtatgaaggtctgagcgccgaccaaatggcccagatcgaagaggtgtttaaggtggtgtaccctgtggatgatcatcactttaaggtgatcctgccctatggcacactggtaatcgacggggttacgccgaacaagctgaactatttcggacggccgtatgaaggcatcgccgtgttcgacggcgagaagatcactaccacagggaccctgtggaacggcaacaaaattatcgacgagcgcctgatcacccccgactaa

SEQ ID NO: 911 - protein, 155 aa, Artificial sequence
  Synthetic
MKHHHHHHVFTLDDFVGDWEQTAAYNLDQVLEQGGVSSLLQNLAVSVTPIMRIVRSGENALKIDIHVIIPYEGLSADQMAQIEEVFKVVYPVDDHHFKVILPYGTLVIDGVTPNKLNYFGRPYEGIAVFDGEKITTTGTLWNGNKIIDERLITPD

SEQ ID NO: 912 - DNA, 468 bp, Artificial sequence
  Synthetic
atgaaacatcaccatcaccatcatgtcttcacactcgacgatttcgttggggactgggaacagacagccgcctacaacctggaccaagtccttgaacagggaggtgtgtccagtttgctgcagaatctcgccgtgtccgtaactccgatcatgaggattgtccggagcggtgaaaatgccctgaagatcgacatccatgtcatcatcccgtatgaaggtctgagcgccgaccaaatggcccagatcgaagaggtgtttaaggtggtgtaccctgtggatgatcatcactttaaggtgatcctgccctatggcacactggtaatcgacggggttacgccgaacaagctgaactatttcggacggccgtatgaaggcatcgccgtgttcgacggcaaaaagatcactaccacagggaccctgcctaacggcaacaaaattatcgacgagcgcctgatcacccccgactaa

SEQ ID NO: 913 - protein, 155 aa, Artificial sequence
  Synthetic
MKHHHHHHVFTLDDFVGDWEQTAAYNLDQVLEQGGVSSLLQNLAVSVTPIMRIVRSGENALKIDIHVIIPYEGLSADQMAQIEEVFKVVYPVDDHHFKVILPYGTLVIDGVTPNKLNYFGRPYEGIAVFDGKKITTTGTLPNGNKIIDERLITPD

SEQ ID NO: 914 - DNA, 468 bp, Artificial sequence
  Synthetic
atgaaacatcaccatcaccatcatgtcttcacactcgacgatttcgttggggactgggaacagacagccgcctacaacctggaccaagtccttgaacagggaggtgtgtccagtttgctgcagaatctcgccgtgtccgtaactccgatcatgaggattgtccggagcggtgaaaatgccctgaagatcgacatccatgtcatcatcccgtatgaaggtctgagcgccgaccaaatggcccagatcgaagaggtgtttaaggtggtgtaccctgtggatgatcatcactttaaggtgatcctgccctatggcacactggtaatcgacggggttacgccgaacaagctgaactatttcggacggccgtatgaaggcatcgccgtgttcgacggcaaaaagatcactaccacagggaccctgtggaacggcaacaaaattatcgacgagcgcctgatcgatcccgactaa

SEQ ID NO: 915 - protein, 155 aa, Artificial sequence
  Synthetic
MKHHHHHHVFTLDDFVGDWEQTAAYNLDQVLEQGGVSSLLQNLAVSVTPIMRIVRSGENALKIDIHVIIPYEGLSADQMAQIEEVFKVVYPVDDHHFKVILPYGTLVIDGVTPNKLNYFGRPYEGIAVFDGKKITTTGTLWNGNKIIDERLIDPD

SEQ ID NO: 916 - DNA, 468 bp, Artificial sequence
  Synthetic
atgaaacatcaccatcaccatcatgtcttcacactcgacgatttcgttggggactgggaacagacagccgcctacaacctggaccaagtccttgaacagggaggtgtgtccagtttgctgcagaatctcgccgtgtccgtaactccgatcatgaggattgtccggagcggtgaaaatgccctgaagatcgacatccatgtcatcatcccgtatgaaggtctgagcgccgaccaaatggcccagatcgaagaggtgtttaaggtggtgtaccctgtggatgatcatcactttaaggtgatcctgccctatggcacactggtaatcgacggggttacgccgaacaagctgaactatttcggacggccgtatgaaggcatcgccgtgttcgacggcaaaaagatcactaccacagggaccctgtggaacggcaacaaaattatcgacgagcgcctgatcaccgatgactaa

SEQ ID NO: 917 - protein, 155 aa, Artificial sequence
  Synthetic
MKHHHHHHVFTLDDFVGDWEQTAAYNLDQVLEQGGVSSLLQNLAVSVTPIMRIVRSGENALKIDIHVIIPYEGLSADQMAQIEEVFKVVYPVDDHHFKVILPYGTLVIDGVTPNKLNYFGRPYEGIAVFDGKKITTTGTLWNGNKIIDERLITDD

SEQ ID NO: 918 - DNA, 468 bp, Artificial sequence
  Synthetic
atgaaacatcaccatcaccatcatgtcttcacactcgacgatttcgttggggactgggaacagacagccgcctacaacctggaccaagtccttgaacagggaggtgtgtccagtttgctgcagaatctcgccgtgtccgtaactccgatcatgaggattgtccggagcggtgaaaatgccctgaagatcgacatccatgtcatcatcccgtatgaaggtctgagcgccgaccaaatggcccagatcgaagaggtgtttaaggtggtgtaccctgtggatgatcatcactttaaggtgatcctgccctatggcacactggtaatcgacggggttacgccgaacaagctgaactatttcggacacccgtatgaaggcatcgccgtgttcgacggcgagaagatcactaccacagggaccctgtggaacggcaacaaaattatcgacgagcgcctgatcacccccgactaa

SEQ ID NO: 919 - protein, 155 aa, Artificial sequence
  Synthetic
MKHHHHHHVFTLDDFVGDWEQTAAYNLDQVLEQGGVSSLLQNLAVSVTPIMRIVRSGENALKIDIHVIIPYEGLSADQMAQIEEVFKVVYPVDDHHFKVILPYGTLVIDGVTPNKLNYFGHPYEGIAVFDGEKITTTGTLWNGNKIIDERLITPD

SEQ ID NO: 920 - DNA, 468 bp, Artificial sequence
  Synthetic
atgaaacatcaccatcaccatcatgtcttcacactcgacgatttcgttggggactgggaacagacagccgcctacaacctggaccaagtccttgaacagggaggtgtgtccagtttgctgcagaatctcgccgtgtccgtaactccgatcatgaggattgtccggagcggtgaaaatgccctgaagatcgacatccatgtcatcatcccgtatgaaggtctgagcgccgaccaaatggcccagatcgaagaggtgtttaaggtggtgtaccctgtggatgatcatcactttaaggtgatcctgccctatggcacactggtaatcgacggggttacgccgaacaagctgaactatttcggacacccgtatgaaggcatcgccgtgttcgacggcgagaagatcactaccacagggaccctgtggaacggcaacaaaattatcgacgagcgcctgatcgatcccgactaa

SEQ ID NO: 921 - protein, 155 aa, Artificial sequence
  Synthetic
MKHHHHHHVFTLDDFVGDWEQTAAYNLDQVLEQGGVSSLLQNLAVSVTPIMRIVRSGENALKIDIHVIIPYEGLSADQMAQIEEVFKVVYPVDDHHFKVILPYGTLVIDGVTPNKLNYFGHPYEGIAVFDGEKITTTGTLWNGNKIIDERLIDPD

SEQ ID NO: 922 - DNA, 468 bp, Artificial sequence
  Synthetic
atgaaacatcaccatcaccatcatgtcttcacactcgacgatttcgttggggactgggaacagacagccgcctacaacctggaccaagtccttgaacagggaggtgtgtccagtttgctgcagaatctcgccgtgtccgtaactccgatcatgaggattgtccggagcggtgaaaatgccctgaagatcgacatccatgtcatcatcccgtatgaaggtctgagcgccgaccaaatggcccagatcgaagaggtgtttaaggtggtgtaccctgtggatgatcatcactttaaggtgatcctgccctatggcacactggtaatcgacggggttacgccgaacaagctgaactatttcggacacccgtatgaaggcatcgccgtgttcgacggcgagaagatcactaccacagggaccctgtggaacggcaacaaaattatcgacgagcgcctgatcgatgatgactaa

SEQ ID NO: 923 - protein, 155 aa, Artificial sequence
  Synthetic
MKHHHHHHVFTLDDFVGDWEQTAAYNLDQVLEQGGVSSLLQNLAVSVTPIMRIVRSGENALKIDIHVIIPYEGLSADQMAQIEEVFKVVYPVDDHHFKVILPYGTLVIDGVTPNKLNYFGHPYEGIAVFDGEKITTTGTLWNGNKIIDERLIDDD

SEQ ID NO: 924 - DNA, 468 bp, Artificial sequence
  Synthetic
atgaaacatcaccatcaccatcatgatttcacactcgacgatttcgttggggactgggaacagacagccgcctacaacctggaccaagtccttgaacagggaggtgtgtccagtttgctgcagaatctcgccgtgtccgtaactccgatcatgaggattgtccggagcggtgaaaatgccctgaagatcgacatccatgtcatcatcccgtatgaaggtctgagcgccgaccaaatggcccagatcgaagaggtgtttaaggtggtgtaccctgtggatgatcatcactttaaggtgatcctgcccatcggcacactggtaatcgacggggttacgccgaacaagctgaactatttcggacacccgtatgaaggcatcgccgtgttcgacggcgagaagatcactaccacagggaccctgtggaacggcaacaaaattatcgacgagcgcctgatcgatcccgactaa

SEQ ID NO: 925 - protein, 155 aa, Artificial sequence
  Synthetic
MKHHHHHHDFTLDDFVGDWEQTAAYNLDQVLEQGGVSSLLQNLAVSVTPIMRIVRSGENALKIDIHVIIPYEGLSADQMAQIEEVFKVVYPVDDHHFKVILPIGTLVIDGVTPNKLNYFGHPYEGIAVFDGEKITTTGTLWNGNKIIDERLIDPD

SEQ ID NO: 926 - DNA, 468 bp, Artificial sequence
  Synthetic
atgaaacatcaccatcaccatcatgtcttcacactcgacgatttcgttggggactgggaacagacagccgcctacaacctggaccaagtccttgaacagggaggtgtgtccagtttgctgcagaatctcgccgtgtccgtaactccgatcatgaggattgtccggagcggtgaaaatgccctgaagatcgacatccatgtcatcatcccgtatgaaggtctgagcgccgaccaaatggcccagatcgaagaggtgtttaaggtggtgtaccctgtggatgatcatcactttaaggtgatcctgcccatcggcacactggtaatcgacggggagacgccgaacaagctgaactatttcggacacccgtatgaaggcatcgccgtgttcgacggcgagaagatcactaccacagggaccctgtggaacggcaacaaaattatcgacgagcgcctgatcgatcccgactaa

SEQ ID NO: 927 - protein, 155 aa, Artificial sequence
  Synthetic
MKHHHHHHVFTLDDFVGDWEQTAAYNLDQVLEQGGVSSLLQNLAVSVTPIMRIVRSGENALKIDIHVIIPYEGLSADQMAQIEEVFKVVYPVDDHHFKVILPIGTLVIDGETPNKLNYFGHPYEGIAVFDGEKITTTGTLWNGNKIIDERLIDPD

SEQ ID NO: 928 - DNA, 468 bp, Artificial sequence
  Synthetic
atgaaacatcaccatcaccatcatgtcttcacactcgacgatttcgttggggactgggaacagacagccgcctacaacctggaccaagtccttgaacagggaggtgtgtccagtttgctgcagaatctcgccgtgtccgtaactccgatcatgaggattgtccggagcggtgaaaatgccctgaagatcgacatccatgtcatcatcccgtatgaaggtctgagcgccgaccaaatggcccagatcgaagaggtgtttaaggtggtgtaccctgtggatgatcatcactttaaggtgatcctgcccatcggcacactggtaatcgacggggttacgccgaacaagctgaactatttcggacacccgtatgaaggcatcgccgatttcgacggcgagaagatcactaccacagggaccctgtggaacggcaacaaaattatcgacgagcgcctgatcgatcccgactaa

SEQ ID NO: 929 - protein, 155 aa, Artificial sequence
  Synthetic
MKHHHHHHVFTLDDFVGDWEQTAAYNLDQVLEQGGVSSLLQNLAVSVTPIMRIVRSGENALKIDIHVIIPYEGLSADQMAQIEEVFKVVYPVDDHHFKVILPIGTLVIDGVTPNKLNYFGHPYEGIADFDGEKITTTGTLWNGNKIIDERLIDPD

SEQ ID NO: 930 - DNA, 468 bp, Artificial sequence
  Synthetic
atgaaacatcaccatcaccatcatgtcttcacactcgacgatttcgttggggactgggaacagacagccgcctacaacctggaccaagtccttgaacagggaggtgtgtccagtttgctgcagaatctcgccgtgtccgtaactccgatcatgaggattgtccggagcggtgaaaatgccctgaagatcgacatccatgtcatcatcccgtatgaaggtctgagcgccgaccaaatggcccagatcgaagaggtgtttaaggtggtgtaccctgtggatgatcatcactttaaggtgatcctgcccatcggcacactggtaatcgacggggagacgccgaacaagctgaactatttcggacacccgtatgaaggcatcgccgatttcgacggcgagaagatcactaccacagggaccctgtggaacggcaacaaaattatcgacgagcgcctgatcgatcccgactaa

SEQ ID NO: 931 - protein, 155 aa, Artificial sequence
  Synthetic
MKHHHHHHVFTLDDFVGDWEQTAAYNLDQVLEQGGVSSLLQNLAVSVTPIMRIVRSGENALKIDIHVIIPYEGLSADQMAQIEEVFKVVYPVDDHHFKVILPIGTLVIDGETPNKLNYFGHPYEGIADFDGEKITTTGTLWNGNKIIDERLIDPD

SEQ ID NO: 932 - DNA, 327 bp, Artificial sequence
  Synthetic
atgaaacatcaccatcaccatcatgtcttcacactcgacgatttcgttggggactgggaacagacagccgcctacaacctggaccaagtccttgaacagggaggtgtgtccagtttgctgcagaatctcgccgtgtccgtaactccgatcatgaggattgtccggagcggtgaaaatgccctgaagatcgacatccatgtcatcatcccgtatgaaggtctgagcgccgaccaaatggcccagatcgaagaggtgtttaaggtggtgtaccctgtggatgatcatcactttaaggtgatcctgccctatggcacactggtaatcgac

SEQ ID NO: 933 - protein, 109 aa, Artificial sequence
  Synthetic
MKHHHHHHVFTLDDFVGDWEQTAAYNLDQVLEQGGVSSLLQNLAVSVTPIMRIVRSGENALKIDIHVIIPYEGLSADQMAQIEEVFKVVYPVDDHHFKVILPYGTLVID

SEQ ID NO: 934 - protein, 158 aa, Artificial sequence
  Synthetic
VFTLEDFVGDWKQTAAYNLDQVLEQGGVSSLLQNLAVSVTPTQRMVRSGENALKIDIHVIIPYEGLSADQMAQIEEVFKVVYPVDDHHFKVILPYGTLVIDGVTPNMLNYFGRPYEGIAVFDGKKITVTGTLWNGVKIIDERLITPDGSMSFRVTINS

SEQ ID NO: 935 - protein, 158 aa, Artificial sequence
  Synthetic
VFTLEDFVGDWNQTAAYNLDQVLEQGGVSSLLQNLAVSVTPIQRMVRSGENALKIDIHVIIPYEGLSADQMAQIEEVFKVVYPVDDHHFKVILPYGTLVIDGVTPNMLNYFGRPYEGIAVFDGKKITVTGTLWNGVKIIDERLITPDGSMSFRVTINS

SEQ ID NO: 936 - DNA, 474 bp, Artificial sequence
  Synthetic
gtcttcacactcgaagatttcgttggggactggaaacagacagccgcctacaacctggaccaagtccttgaacagggaggtgtgtccagtttgctgcagaatctcgccgtgtccgtaactccgatccaaaggatggtccggagcggtgaaaatgccctgaagatcgacatccatgtcatcatcccgtatgaaggtctgagcgccgaccaaatggcccagatcgaagaggtgtttaaggtggtgtaccctgtggatgatcatcactttaaggtgatcctgccctatggcacactggtaatcgacggggttacgccgaacatgctgaactatttcggacggccgtatgaaggcatcgccgtgttcgacggcaaaaagatcactgtaacagggaccctgtggaacggcgtcaaaattatcgacgagcgcctgatcacccccgacggctccatgtccttccaagtaaccatcaacagc

SEQ ID NO: 937 - protein, 158 aa, Artificial sequence
  Synthetic
VFTLEDFVGDWKQTAAYNLDQVLEQGGVSSLLQNLAVSVTPIQRMVRSGENALKIDIHVIIPYEGLSADQMAQIEEVFKVVYPVDDHHFKVILPYGTLVIDGVTPNMLNYFGRPYEGIAVFDGKKITVTGTLWNGVKIIDERLITPDGSMSFQVTINS

SEQ ID NO: 938 - DNA, 474 bp, Artificial sequence
  Synthetic
gtcttcacactcgaagatttcgttggggactggaaacagacagccgcctacaacctggaccaagtccttgaacagggaggtgtgtccagtttgctgcagaatctcgccgtgtccgtaactccgatccaaaggatggtccggagcggtgaaaatgccctgaagatcgacatccatgtcatcatcccgtatgaaggtctgagcgccgaccaaatggcccagatcgaagaggtgtttaaggtggtgtaccctgtggatgatcatcactttaaggtgatcctgccctatggcacactggtaatcgacggggttacgccgaacatgctgaactatttcggacggccgtatgaaggcatcgccgtgttcgacggcaaaaagatcactgtaacagggaccctgtggaacggcgccaaaattatcgacgagcgcctgatcacccccgacggctccatgtccttccgagtaaccatcaacagc

SEQ ID NO: 939 - protein, 158 aa, Artificial sequence
  Synthetic
VFTLEDFVGDWKQTAAYNLDQVLEQGGVSSLLQNLAVSVTPIQRMVRSGENALKIDIHVIIPYEGLSADQMAQIEEVFKVVYPVDDHHFKVILPYGTLVIDGVTPNMLNYFGRPYEGIAVFDGKKITVTGTLWNGAKIIDERLITPDGSMSFRVTINS

SEQ ID NO: 940 - DNA, 474 bp, Artificial sequence; identical to SEQ ID NO: 603
  Synthetic

SEQ ID NO: 941 - protein, 158 aa, Artificial sequence; identical to SEQ ID NO: 604
  Synthetic

SEQ ID NO: 942 - DNA, 474 bp, Artificial sequence
  Synthetic
gtcttcacactcgaagatttcgttggggactggaaacagacagccgcctacaacctggaccaagtccttgaacagggaggtgtgtccagtttgctgcagaatctcgccgtgtccgtaactccgatccaaaggatggtccggagcggtgaaaatgccctgaagatcgacatccaagtcatcatcccgtatgaaggtctgagcgccgaccaaatggcccagatcgaagaggtgtttaaggtggtgtaccctgtggatgatcatcactttaaggtgatcctgccctatggcacactggtaatcgacggggttacgccgaacatgctgaactatttcggacggccgtatgaaggcatcgccgtgttcgacggcaaaaagatcactgtaacagggaccctgtggaacggcgtcaaaattatcgacgagcgcctgatcacccccgacggctccatgtccttccgagtaaccatcaacagc

SEQ ID NO: 943 - protein, 158 aa, Artificial sequence; identical to SEQ ID NO: 604
  Synthetic

SEQ ID NO: 944 - DNA, 474 bp, Artificial sequence; identical to SEQ ID NO: 942
  Synthetic

SEQ ID NO: 945 - protein, 158 aa, Artificial sequence
  Synthetic
VFTLEDFVGDWKQTAAYNLDQVLEQGGVSSLLQNLAVSVTPIQRMVRSGENALKIDIQVIIPYEGLSADQMAQIEEVFKVVYPVDDHHFKVILPYGTLVIDGVTPNMLNYFGRPYEGIAVFDGKKITVTGTLWNGVKIIDERLITPDGSMSFRVTINS

SEQ ID NO: 946 - DNA, 474 bp, Artificial sequence
  Synthetic
gtcttcacactcgaagatttcgttggggactggaaacagacagccgcctacaacctggaccaagtccttgaacagggaggtgtgtccagtttgctgcagaaactcgccgtgtccgtaactccgatccaaaggatggtccggagcggtgaaaatgccctgaagatcgacatccacgtcatcatcccgtatgaaggtctgagcgccgaccaaatggcccagatcgaagaggtgtttaaggtggtgtaccctgtggatgatcatcactttaaggtgatcctgccctatggcacactggtaatcgacggggttacgccgaacatgctgaactatttcggacggccgtatgaaggcatcgccgtgttcgacggcaaaaagatcactgtaacagggaccctgtggaacggcgtcaaaattatcgacgagcgcctgatcacccccgacggctccatgtccttccgagtaaccgtcaacagc

SEQ ID NO: 947 - protein, 158 aa, Artificial sequence
  Synthetic
VFTLEDFVGDWKQTAAYNLDQVLEQGGVSSLLQKLAVSVTPIQRMVRSGENALKIDIHVIIPYEGLSADQMAQIEEVFKVVYPVDDHHFKVILPYGTLVIDGVTPNMLNYFGRPYEGIAVFDGKKITVTGTLWNGVKIIDERLITPDGSMSFRVTVNS

SEQ ID NO: 948 - DNA, 474 bp, Artificial sequence
  Synthetic
gtcttcacactcgaagatttcgttggggactggaaacagacagccgcctacaacctggaccaagtccttgaacagggaggtgtgtccagtttgctgcagaatctcgccgtgtccgtaactccgatccaaaggatggtccggagcggtgaaaatgccctgaaggtcgacatccatgtcatcatcccgtatgaaggtctgagcgccgaccaaatggcccagatcgaagaggtgtttaaggtggtgtaccctgtggatgatcatcactttaaggtgatcctgccctatggcacactggtaatcgacggggttacgccgaacatgctgaactatttcggacggccgtatgaaggcatcgccgtgttcgacggcaaaaagatcactgcaacagggaccctgtggaacggcgtcaaaattatcgacgagcgcctgatcacccccgacggctccatgtccttccgagtaaccatcaacagc

SEQ ID NO: 949 - protein, 157 aa, Artificial sequence
  Synthetic
VFTLEDFVGDWKQTAAYNLDQVLEQGGVSSLLQNLAVSVTPIQRMVRSGENALKVDIHVIIPYEGLSADQMAQIEEVFKVVYPVDDHHFKVILPYGTLVIDGVTPNMLNYFGRPYEGIAVFDGKKITATGTLWNGVKIIDERLITPDGSMSFRVTIN

SEQ ID NO: 950 - DNA, 474 bp, Artificial sequence
  Synthetic
gtcttcacactcgaagatttcgttggggactggaaacagacagccgcctacaacctggaccaagtccttgaacagggaggtgtgtccagtttgctgcagaatctcgccgtgtccgtaactccgatccaaaggttggtccggagcggtgaaaatgccctgaagatcgacatccatgtcatcatcccgtatgaaggtctgagcgccgaccaaatggcccagatcgaagaggtgtttaaggtggtgtaccctgtggatgatcatcactttaaggtgatcctgccctatggcacactggtaatcgacggggttacgccgaacatgctgaactatttcggacggccgtatgaaggcatcgccgtgttcgacggcaaaaagatcactgtaacagggaccctgtggaacggcgccaaaattatcgacgagcgcctgatcacccccgacggctccatgtccttccgagtaaccatcaacagc

SEQ ID NO: 951 - protein, 158 aa, Artificial sequence
  Synthetic
VFTLEDFVGDWKQTAAYNLDQVLEQGGVSSLLQNLAVSVTPIQRLVRSGENALKIDIHVIIPYEGLSADQMAQIEEVFKVVYPVDDHHFKVILPYGTLVIDGVTPNMLNYFGRPYEGIAVFDGKKITVTGTLWNGAKIIDERLITPDGSMSFRVTINS

SEQ ID NO: 952 - DNA, 474 bp, Artificial sequence
  Synthetic
gtcttcacactcgaagatttcgttggggactggaaacagacagccgcctacaacctggaccaagtccttgaacagggaggtgtgtccagtttgctgcagaatctcgccgtgtccgtaactccgatccaaaggatggtccggagcggtgaaaatgccctgaagatcgacatccatgtcatcatcccgtatgaaggtctgagcgccgaccaaatggcccagatcgaagaggtgtttaaggtggtgtaccctgtggatgatcatcactttaaggtgatcctgccctatggcacactggtaatcgacggggttacgccgaacatgctgaactatttcggacggccgtatgaaggcatcgccgcgttcgacggcaaaaagatcactgtaacagggaccctgtggaacggcgtcaaaattatcgacgagcgcctgatcacccccgacggctccatgtccttccgagtaaccatcaacagc

SEQ ID NO: 953 - protein, 158 aa, Artificial sequence
  Synthetic
VFTLEDFVGDWKQTAAYNLDQVLEQGGVSSLLQNLAVSVTPIQRMVRSGENALKIDIHVIIPYEGLSADQMAQIEEVFKVVYPVDDHHFKVILPYGTLVIDGVTPNMLNYFGRPYEGIAAFDGKKITVTGTLWNGVKIIDERLITPDGSMSFRVTINS

SEQ ID NO: 954 - DNA, 474 bp, Artificial sequence
  Synthetic
gtcttcacactcgaagatttcgttggggcctggaaacagacagccgcctacaacctggaccaagtccttgaacagggaggtgtgtccagtttgctgcagaatctcgccgtgtccgtaactccgatccaaaggatggtccggagcggtgaaaatgccctgaagatcgacatccaagtcatcatcccgtatgaaggtctgagcgccgaccaaatggcccagatcgaagaggtgtttaaggtggtgtaccctgtggatgatcatcactttaaggtgatcctgccctatggcacactggtaatcgacggggttacgccgaacatgctgaactatttcggacggccgtatgaaggcatcgccgtgttcgacggcaaaaagatcactgtaacagggaccctgtggaacggcgtcaaaattatcgacgagcgcctgatcacccccgacggctccatgtccttccgagtaaccatcaacagc

SEQ ID NO: 955 - protein, 158 aa, Artificial sequence
  Synthetic
VFTLEDFVGAWKQTAAYNLDQVLEQGGVSSLLQNLAVSVTPIQRMVRSGENALKIDIQVIIPYEGLSADQMAQIEEVFKVVYPVDDHHFKVILPYGTLVIDGVTPNMLNYFGRPYEGIAVFDGKKITVTGTLWNGVKIIDERLITPDGSMSFRVTINS

SEQ ID NO: 956 - DNA, 474 bp, Artificial sequence
  Synthetic
gtcttcacactcgaagatttcgtaggggactggaaacagacagccgcctacaacctggaccaagtccttgaacagggaggtgtgtccagtttgctgcaggatctcgccgtgtccgtaactccgacccaaaggatggtccggagcggtgaaaatgccctgaagatcgacatccatgtcatcatcccgtatgaaggtctgagcgccgaccaaatggcccagatcgaagaggtgtttaaggtggtgtaccctgtggatgatcatcactttaaggtgatcctgccctatggcacactggtaatcgacggggttacgccgaacatgctgaactatttcggacggccgtatgaaggcatcgccgtgttcgacggcaaaaagatcactgtaacagggaccctgtggaacggcgtcaaaattatcgacgagcgcctgatcacccccgacggctccatgtccttccgagtaaccatcaacagc

SEQ ID NO: 957 - protein, 158 aa, Artificial sequence
  Synthetic
VFTLEDFVGDWKQTAAYNLDQVLEQGGVSSLLQDLAVSVTPTQRMVRSGENALKIDIHVIIPYEGLSADQMAQIEEVFKVVYPVDDHHFKVILPYGTLVIDGVTPNMLNYFGRPYEGIAVFDGKKITVTGTLWNGVKIIDERLITPDGSMSFRVTINS

SEQ ID NO: 958 - DNA, 474 bp, Artificial sequence
  Synthetic
gtcttcacactcgaagatttcgttggggactggagacagactgccgcctacaacctggaccaagtccttgaacagggaggtgtgtccagtttgctgcggaatctcgccgtgtccgtaactccgatccaaaggatggtccggagcggtgaaaatgccctgaagatcgacatccatgtcatcatcccgtatgaaggtctgagcgccgaccaaatggcccagatcgaagaggtgtttaaggtggtgtaccctgtggatgatcatcactttaaggtgatcctgccctatggcacactggtaatcgacggggttacgccgaacatgctgaactatttcggacggccgtatgaaggcatcgccgtgttcgacggcaaaaagatcactgtaacagggaccctgtggaacggcgtcaaaattatcgacgagcgcctgatcacccccgacggctccatgtccttccgagtaaccaccaacagc

SEQ ID NO: 959 - protein, 158 aa, Artificial sequence
  Synthetic
VFTLEDFVGDWRQTAAYNLDQVLEQGGVSSLLRNLAVSVTPIQRMVRSGENALKIDIHVIIPYEGLSADQMAQIEEVFKVVYPVDDHHFKVILPYGTLVIDGVTPNMLNYFGRPYEGIAVFDGKKITVTGTLWNGVKIIDERLITPDGSMSFRVTTNS

SEQ ID NO: 960 - DNA, 474 bp, Artificial sequence
  Synthetic
gtcttcacactcgaagatttcgttggggactggaaacagacagccgcctacaacctggtccaagtccttgaacagggaggtgtgtccagtttgctgcagaatctcgccgtgtccgtaactccgatccaaaggatggtccggagcggtgaaaatgccctgaagatcgacatccatgtcatcatcccgtatgaaggtctgagcgccgaccaaatggcccagatcgaagaggtgtttaaggtggtgtaccctgtggatgatcatcactttaaggtgatcctgccctatggcacactggtaatcgacggggttacgccgaacacgctgaactatttcggacggccgtatgaaggcatcgccgtgctcgacggcaaaaagatcactgtaacagggaccctgtggaacggcgtcaaaattatcgacgagcgcctgatcacccccgacggctccatgtccttccgagtaaccatcaacagc

SEQ ID NO: 961 - protein, 158 aa, Artificial sequence
  Synthetic
VFTLEDFVGDWKQTAAYNLVQVLEQGGVSSLLQNLAVSVTPIQRMVRSGENALKIDIHVIIPYEGLSADQMAQIEEVFKVVYPVDDHHFKVILPYGTLVIDGVTPNTLNYFGRPYEGIAVLDGKKITVTGTLWNGVKIIDERLITPDGSMSFRVTINS

SEQ ID NO: 962 - DNA, 474 bp, Artificial sequence
  Synthetic
gtcttcacactcgaagatttcgttggggactggaaacagacagccgcctacaacctggaccaagtccttgaacagggaggtgtgtccagtttgctgcagaatctcgccgtgtccgtaactccgaaccaaaggatggtccggagcggtgaaaatgccctgaagatcgacatccatgtcatcatcccgtatggaggtctgagcgccgaccaaatggcccagatcgaagaggtgtttaaggtggtgtaccctgtggatgatcatcactttaaggtgatcctgccctatggcacactggtaatcgacggggttacgccgaacatgctgaactatttcggacggccgtatgaaggcatcgccgtgttcgacggcaaaaagatcactgtgacagggaccctgtggaacggcgtcaaaattatcgacgagcgcctgatcacccccgacggctccatgtccttccgagtaaccatcaacagc

SEQ ID NO: 963 - protein, 157 aa, Artificial sequence
  Synthetic
VFTLEDFVGDWKQTAAYNLDQVLEQGGVSSLLQNLAVSVTPNQRMVRSGENALKIDIHVIIPYGGLSADQMAQIEEVFKVVYPVDDHHFKVILPYGTLVIDGVTPNMLNYFGRPYEGIAVFDGKKITVTGTLWNGVKIIDERLITPDGSMSFRVTIN

SEQ ID NO: 964 - DNA, 474 bp, Artificial sequence
  Synthetic
gtcttcacactcgaagatttcgttggggactggaaacagacagccgcctacaacctggaccaagtccttgaacagggaggtgtgtccagtttgctgcagaacctcgccgtgtccgtaactccgatccaaaggatggtccggagcggtgaaagtgccctgaagatcgacatccatgtcatcatcccgtatgaaggtctgagcgccgaccaaatggcccagatcgaagaggtgtttaaggtggtgtaccctgtggatgatcatcactttaaggtgatcctgccctatggcacactggtaatcgacggggttacgccgaacatgctgaactatttcggacggccgtatgaaggcatcgccgtgttcgacggcaaaaagatcactgtaacagggaccctgtggaacggcgtcaaaattatcgacgagcgcctgatcacccccgacggctccatgtccttccgagtaaccatcaacagc

SEQ ID NO: 965 - protein, 158 aa, Artificial sequence
  Synthetic
VFTLEDFVGDWKQTAAYNLDQVLEQGGVSSLLQNLAVSVTPIQRMVRSGESALKIDIHVIIPYEGLSADQMAQIEEVFKVVYPVDDHHFKVILPYGTLVIDGVTPNMLNYFGRPYEGIAVFDGKKITVTGTLWNGVKIIDERLITPDGSMSFRVTINS

SEQ ID NO: 966 - DNA, 474 bp, Artificial sequence
  Synthetic
gtcttcacacacgaagatttcgttggggactggaaacagacagccgcctacaacctggaccaagtccttgaacagggaggtgtgtccagtttgctgcagaatctcgccgtgtccgtaactccgatccaaaggatggtccggagcggtgaaaatgccctgaagatcgacatccatgtcatcatcccgtatgaaggtctgagcgccgaccaaatggcccagatcgaagaggtgtttaaggtggtgtaccctgtggatgatcatcactttaaggtgatcctgccctatggcacactggtaatcgacggggttacgccgaacatgctgaactatttcggacggccgtatgaaggcatcgccgtgttcgacggcaaaaagatcactgtaacagggaccctgtggaacggcgtcaaaattatcgacgagcgcctgatcacccccgacggctccatgtccttccgagtaaccatcaacagc

SEQ ID NO: 967 - protein, 158 aa, Artificial sequence
  Synthetic
VFTHEDFVGDWKQTAAYNLDQVLEQGGVSSLLQNLAVSVTPIQRMVRSGENALKIDIHVIIPYEGLSADQMAQIEEVFKVVYPVDDHHFKVILPYGTLVIDGVTPNMLNYFGRPYEGIAVFDGKKITVTGTLWNGVKIIDERLITPDGSMSFRVTINS

SEQ ID NO: 968 - protein, 474 aa, Artificial sequence
  Synthetic
GTCTTCACACTCGAAGATTTCGTTGGGGACTGGAAACAGTCAGCCGCCTACAACCTGGACCAAGTCCTTGAACAGGGAGGTGTGTCCAGTTTGCTGCAGAATCTCGCCGTGTCCGTAACTCCGATCCAAAGGATGGTCCGGAGCGGTGAAAATGCCCTGAAGATCGACATCCATGTCATCATCCCGTATGAAGGTCTGAGCGCCGACCAAATGGCCCAGATCGAAGAGGTGTTTAAGGTGGTGTACCCTGTGGATGATCATCACTTTAAGGTGATCCTGCCCTATGGCACACTGGTAATCGACGGGGTTACGCCGAACATGCTGAACTATTTCGGACGGCCGTATGAAGGCATCGCCGTGTTCGACGGCAAAAAGATCACTGTAACAGGGACCCTGTGGAACGGCGTCAAAATTATCGACGAGCGCCTGATCACCCCCGACGGCTCCATGTCCTTCCGAGTAACCATCAACAGC

SEQ ID NO: 969 - protein, 158 aa, Artificial sequence
  Synthetic
VFTLEDFVGDWKQSAAYNLDQVLEQGGVSSLLQNLAVSVTPIQRMVRSGENALKIDIHVIIPYEGLSADQMAQIEEVFKVVYPVDDHHFKVILPYGTLVIDGVTPNMLNYFGRPYEGIAVFDGKKITVTGTLWNGVKIIDERLITPDGSMSFRVTINS

SEQ ID NO: 970 - DNA, 474 bp, Artificial sequence
  Synthetic
gtcttcacactcgaagatttcgttggggactggaaacagacagccgcctacaacctggaccaagtccttgaacagggaggtgtgtccagtttgctgcagaatctcgccgtgtccgtaactccgatccaaaggatggtccggagcggtgaaaatgccctgaagatcgacatccatgtcatcatcccgtatgaaggtctgagcgccgaccaaatggcccagatcgaagaggtgtttaaggtggtgtaccctgtggatgatcatcactttaaggtgatcctgcactatggcacactggtaatcgacggggttacgccgaacatgctgaactatttcggacggccgtatgaaggcatcgccgtgttcgacggcaaaaagatcactgtaacagggaccctgtggaacggcgtcaaaattatcgacgagcgcctgatcacccccgacggctccatgtccttccgagtaaccatcaacagc

SEQ ID NO: 971 - DNA, 906 bp, Artificial sequence
  Synthetic
atgaactccttctccacaagcgccttcggtccagttgccttctccctgggcctgctcctggtgttgcctgctgccttccctgccccagactacaaagaccatgacggtgattataaagatcatgacatcgattacaaggatgacgatgacaagagagtccaacctactgaatctattgttagatttcctaatattactaatctttgtccttttggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcgggagctccggtggtggcgggagcggaggtggaggctcgagcggtggcaagctcctgttcacggtaaccatcgagaagtataag

SEQ ID NO: 972 - protein, 302 aa, Artificial sequence
  Synthetic
MNSFSTSAFGPVAFSLGLLLVLPAAFPAPDYKDHDGDYKDHDIDYKDDDDKRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFGSSGGGGSGGGGSSGGKLLFTVTIEKYK

SEQ ID NO: 973 - DNA, 906 bp, Artificial sequence
  Synthetic
atgaactccttctccacaagcgccttcggtccagttgccttctccctgggcctgctcctggtgttgcctgctgccttccctgccccagtctccgtgagcggctggcggctgttcaagaagattagcgggagctccggtggtggcgggagcggaggtggaggctcgagcggtagagtccaacctactgaatctattgttagatttcctaatattactaatctttgtccttttggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcgactacaaagaccatgacggtgattataaagatcatgacatcgattacaaggatgacgatgacaag

SEQ ID NO: 974 - protein, 302 aa, Artificial sequence
  Synthetic
MNSFSTSAFGPVAFSLGLLLVLPAAFPAPVSVSGWRLFKKISGSSGGGGSGGGGSSGRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFDYKDHDGDYKDHDIDYKDDDDK

SEQ ID NO: 975 - DNA, 906 bp, Artificial sequence
  Synthetic
atgaactccttctccacaagcgccttcggtccagttgccttctccctgggcctgctcctggtgttgcctgctgccttccctgccccaggcaagctcctgttcacggtaaccatcgagaagtataaggggagctccggtggtggcgggagcggaggtggaggctcgagcggtagagtccaacctactgaatctattgttagatttcctaatattactaatctttgtccttttggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcgactacaaagaccatgacggtgattataaagatcatgacatcgattacaaggatgacgatgacaag

SEQ ID NO: 976 - protein, 300 aa, Artificial sequence
  Synthetic
MNSFSTSAFGPVAFSLGLLLVLPAAFPAPGKLLFTVTIEKYKGSSGGGGSGGGGSSGRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFDYKDHDGDYKDHDIDYKDDD

SEQ ID NO: 977 - DNA, 1914 bp, Artificial sequence
  Synthetic
atggactcgggccgggacttcctgaccctgcacggcctacaggatgatgaggatctacaggcgctgctgaagggcagccagctcctgaaggtgaagtccagctcatggaggagagagcggttctacaagttgcaggaggactgcaagaccatctggcaggagtcccgcaaggtcatgcggaccccggagtcccagctgttctccatcgaggacattcaggaggtgcgaatggggcaccgcacggagggtctggagaagttcgcccgtgatgtgcccgaggaccgctgcttctccattgtcttcaaggaccagcgcaatacactagacctcatcgccccatcgccagctgatgcccagcactgggtgctggggctgcacaagatcatccaccactcaggctccatggaccagcgtcagaagctacagcactggattcactcctgcttgcgaaaagctgacaaaaacaaggacaacaagatgagcttcaaggagctgcagaacttcctgaaggagctcaacatccagctcggctcttcaggcgcagaaatcggtactggctttccattcgacccccattatgtggaagtcctgggcgagcgcatgcactacgtcgatgttggtccgcgcgatggcacccctgtgctgttcctgcacggtaacccgacctcctcctacgtgtggcgcaacatcatcccgcatgttgcaccgacccatcgctgcattgctccagacctgatcggtatgggcaaatccgacaaaccagacctgggttatttcttcgacgaccacgtccgcttcatggatgccttcatcgaagccctgggtctggaagaggtcgtcctggtcattcacgactggggctccgctctgggtttccactgggccaagcgcaatccagagcgcgtcaaaggtattgcatttatggagttcatccgccctatcccgacctgggacgaatggccagaatttgcccgcgagaccttccaggccttccgcaccaccgacgtcggccgcaagctgatcatcgatcagaacgtttttatcgagggtacgctgccgatgggtgtcgtccgcccgctgactgaagtcgagatggaccattaccgcgagccgttcctgaatcctgttgaccgcgagccactgtggcgcttcccaaacgagctgccaatcgccggtgagccagcgaacatcgtcgcgctggtcgaagaatacatggactggctgcaccagtcccctgtcccgaagctgctgttctggggcaccccaggcgttctgatcccaccggccgaagccgctcgcctggccaaaagcctgcctaactgcaaggctgtggacatcggcccgggtctgaatctgctgcaagaagacaacccggacctgatcggcagcgagatcgcgcgctggctgtcgacgctggagatttccggcggctcgagcggtgtcttcactttggaagatttcgtgggtgactggaaacagactgcagcatacaacttagaccaagtgttggaacagggtggagttagttcgcttttacagaatttggcagttagtgttacgcctatacaacgtatggtgagatcgggagaaaatgcattaaaaatagacatacatgtgataataccttatgaaggattatcggcagaccaaatggcacagatagaagaggtttttaaagttgtttacccagttgatgatcatcactttaaagttatattacactatggaactttagttatagacggtgtgactcctaacatgttaaactatttcggtagaccttatgaaggaatagcagttttcgacggaaagaaaataacggttactggtacgttatggaacggagccaagataatagacgagagattaataacgccagacggaagtatgagtttccaggttacgataaactcg

SEQ ID NO: 978 - protein, 638 aa, Artificial sequence
  Synthetic
MDSGRDFLTLHGLQDDEDLQALLKGSQLLKVKSSSWRRERFYKLQEDCKTIWQESRKVMRTPESQLFSIEDIQEVRMGHRTEGLEKFARDVPEDRCFSIVFKDQRNTLDLIAPSPADAQHWVLGLHKIIHHSGSMDQRQKLQHWIHSCLRKADKNKDNKMSFKELQNFLKELNIQLGSSGAEIGTGFPFDPHYVEVLGERMHYVDVGPRDGTPVLFLHGNPTSSYVWRNIIPHVAPTHRCIAPDLIGMGKSDKPDLGYFFDDHVRFMDAFIEALGLEEVVLVIHDWGSALGFHWAKRNPERVKGIAFMEFIRPIPTWDEWPEFARETFQAFRTTDVGRKLIIDQNVFIEGTLPMGVVRPLTEVEMDHYREPFLNPVDREPLWRFPNELPIAGEPANIVALVEEYMDWLHQSPVPKLLFWGTPGVLIPPAEAARLAKSLPNCKAVDIGPGLNLLQEDNPDLIGSEIARWLSTLEISGGSSGVFTLEDFVGDWKQTAAYNLDQVLEQGGVSSLLQNLAVSVTPIQRMVRSGENALKIDIHVIIPYEGLSADQMAQIEEVFKVVYPVDDHHFKVILHYGTLVIDGVTPNMLNYFGRPYEGIAVFDGKKITVTGTLWNGAKIIDERLITPDGSMSFQVTINS

SEQ ID NO: 979 - protein, 159 aa, Artificial sequence; identical to SEQ ID NO: 768
  Synthetic

SEQ ID NO: 980 - protein, 459 aa, Artificial sequence
  Synthetic
MAEIGTGFPFDPHYVEVLGERMHYVDVGPRDGTPVLFLHGNPTSSYVWRNIIPHVAPTHRCIAPDLIGMGKSDKPDLGYFFDDHVRFMDAFIEALGLEEVVLVIHDWGSALGFHWAKRNPERVKGIAFMEFIRPIPTWDEWPEFARETFQAFRTTDVGRKLIIDQNVFIEGTLPMGVVRPLTEVEMDHYREPFLNPVDREPLWRFPNELPIAGEPANIVALVEEYMDWLHQSPVPKLLFWGTPGVLIPPAEAARLAKSLPNCKAVDIGPGLNLLQEDNPDLIGSEIARWLSTLEISGGSSGVFTLEDFVGDWKQTAAYNLDQVLEQGGVSSLLQNLAVSVTPIQRMVRSGENALKIDIHVIIPYEGLSADQMAQIEEVFKVVYPVDDHHFKVILHYGTLVIDGVTPNMLNYFGRPYEGIAVFDGKKITVTGTLWNGAKIIDERLITPDGSMSFQVTINS

SEQ ID NO: 981 - protein, 638 aa, Artificial sequence; identical to SEQ ID NO: 978
  Synthetic

SEQ ID NO: 982 - protein, 510 aa, Artificial sequence
  Synthetic
MPKKKRKVAEIGTGFPFDPHYVEVLGERMHYVDVGPRDGTPVLFLHGNPTSSYVWRNIIPHVAPTHRCIAPDLIGMGKSDKPDLGYFFDDHVRFMDAFIEALGLEEVVLVIHDWGSALGFHWAKRNPERVKGIAFMEFIRPIPTWDEWPEFARETFQAFRTTDVGRKLIIDQNVFIEGTLPMGVVRPLTEVEMDHYREPFLNPVDREPLWRFPNELPIAGEPANIVALVEEYMDWLHQSPVPKLLFWGTPGVLIPPAEAARLAKSLPNCKAVDIGPGLNLLQEDNPDLIGSEIARWLSTLEISGGSSGVFTLEDFVGDWKQTAAYNLDQVLEQGGVSSLLQNLAVSVTPIQRMVRSGENALKIDIHVIIPYEGLSADQMAQIEEVFKVVYPVDDHHFKVILHYGTLVIDGVTPNMLNYFGRPYEGIAVFDGKKITVTGTLWNGAKIIDERLITPDGSMSFQVTINSPKKKRKVPKKKRKVPPPVSKRESKSRSRSKSPPKSPEEEGAVSS

SEQ ID NO: 983 - protein, 604 aa, Artificial sequence
  Synthetic
MSVLTPLLLRGLTGSARRLPVPRAKIHSLGDPMSVLTPLLLRGLTGSARRLPVPRAKIHSLGKLMSVLTPLLLRGLTGSARRLPVPRAKIHSLGDPMSVLTPLLLRGLTGSARRLPVPRAKIHSLGKLRILQSTVPRARDPPVATMAEIGTGFPFDPHYVEVLGERMHYVDVGPRDGTPVLFLHGNPTSSYVWRNIIPHVAPTHRCIAPDLIGMGKSDKPDLGYFFDDHVRFMDAFIEALGLEEVVLVIHDWGSALGFHWAKRNPERVKGIAFMEFIRPIPTWDEWPEFARETFQAFRTTDVGRKLIIDQNVFIEGTLPMGVVRPLTEVEMDHYREPFLNPVDREPLWRFPNELPIAGEPANIVALVEEYMDWLHQSPVPKLLFWGTPGVLIPPAEAARLAKSLPNCKAVDIGPGLNLLQEDNPDLIGSEIARWLSTLEISGGSSGVFTLEDFVGDWKQTAAYNLDQVLEQGGVSSLLQNLAVSVTPIQRMVRSGENALKIDIHVIIPYEGLSADQMAQIEEVFKVVYPVDDHHFKVILHYGTLVIDGVTPNMLNYFGRPYEGIAVFDGKKITVTGTLWNGAKIIDERLITPDGSMSFQVTINS

SEQ ID NO: 984 - protein, 480 aa, Artificial sequence
  Synthetic
MLLSVPLLLGLLGLAVAVFTLEDFVGDWEQTAAYNLDQVLEQGGVSSLLQNLAVSVTPIQRIVRSGENALKIDIHVIIPYEGLSADQMAQIEEVFKVVYPVDDHHFKVILPYGTLVIDGVTPNMLNYFGRPYEGIAVFDGKKITVTGTLWNGNKIIDERLITPDGSMLFRVTINSGSSGMAEIGTGFPFDPHYVEVLGERMHYVDVGPRDGTPVLFLHGNPTSSYVWRNIIPHVAPTHRCIAPDLIGMGKSDKPDLGYFFDDHVRFMDAFIEALGLEEVVLVIHDWGSALGFHWAKRNPERVKGIAFMEFIRPIPTWDEWPEFARETFQAFRTTDVGRKLIIDQNVFIEGTLPMGVVRPLTEVEMDHYREPFLNPVDREPLWRFPNELPIAGEPANIVALVEEYMDWLHQSPVPKLLFWGTPGVLIPPAEAARLAKSLPNCKAVDIGPGLNLLQEDNPDLIGSEIARWLSTLEISGKDEL

SEQ ID NO: 985 - protein, 595 aa, Artificial sequence
  Synthetic
MAEIGTGFPFDPHYVEVLGERMHYVDVGPRDGTPVLFLHGNPTSSYVWRNIIPHVAPTHRCIAPDLIGMGKSDKPDLGYFFDDHVRFMDAFIEALGLEEVVLVIHDWGSALGFHWAKRNPERVKGIAFMEFIRPIPTWDEWPEFARETFQAFRTTDVGRKLIIDQNVFIEGTLPMGVVRPLTEVEMDHYREPFLNPVDREPLWRFPNELPIAGEPANIVALVEEYMDWLHQSPVPKLLFWGTPGVLIPPAEAARLAKSLPNCKAVDIGPGLNLLQEDNPDLIGSEIARWLSTLEISGGSSGVFTLEDFVGDWKQTAAYNLDQVLEQGGVSSLLQNLAVSVTPIQRMVRSGENALKIDIHVIIPYEGLSADQMAQIEEVFKVVYPVDDHHFKVILHYGTLVIDGVTPNMLNYFGRPYEGIAVFDGKKITVTGTLWNGAKIIDERLITPDGSMSFQVTINSSGLRSRGEPQQSFSEAQQQLCNTRQEVNELRKLLEEERDQRVAAENALSVAEEQIRRLEHSEWDSSRTPIIGSCGTQEQALLIDLTSNSCRRTRSGVGWKRVLRSLCHSRTRVPLLAAIYFLMIHVLLILCFTGHL

SEQ ID NO: 986 - protein, 883 aa, Artificial sequence
  Synthetic
MAAPGSARRPLLLLLLLLLLGLMHCASAAMFMVKNGNGTACIMANFSAAFSVNYDTKSGPKNMTFDLPSDATVVLNRSSCGKENTSDPSLVIAFGRGHTLTLNFTRNATRYSVQLMSFVYNLSDTHLFPNASSKEIKTVESITDIRADIDKKYRCVSGTQVHMNNVTVTLHDATIQAYLSNSSFSRGETRCEQDRPSPTTAPPAPPSPSPSPVPKSPSVDKYNVSGTNGTCLLASMGLQLNLTYERKDNTTVTRLLNINPNKTSASGSCGAHLVTLELHSEGTTVLLFQFGMNASSSRFFLQGIQLNTILPDARDPAFKAANGSLRALQATVGNSYKCNAEEHVRVTKAFSVNIFKVWVQAFKVEGGQFGSVEECLLDENSMLIPIAVGGALAGLVLIVLIAYLVGRKRSHAGYQTIKDPPVATMAEIGTGFPFDPHYVEVLGERMHYVDVGPRDGTPVLFLHGNPTSSYVWRNIIPHVAPTHRCIAPDLIGMGKSDKPDLGYFFDDHVRFMDAFIEALGLEEVVLVIHDWGSALGFHWAKRNPERVKGIAFMEFIRPIPTWDEWPEFARETFQAFRTTDVGRKLIIDQNVFIEGTLPMGVVRPLTEVEMDHYREPFLNPVDREPLWRFPNELPIAGEPANIVALVEEYMDWLHQSPVPKLLFWGTPGVLIPPAEAARLAKSLPNCKAVDIGPGLNLLQEDNPDLIGSEIARWLSTLEISGGSSGVFTLEDFVGDWKQTAAYNLDQVLEQGGVSSLLQNLAVSVTPIQRMVRSGENALKIDIHVIIPYEGLSADQMAQIEEVFKVVYPVDDHHFKVILHYGTLVIDGVTPNMLNYFGRPYEGIAVFDGKKITVTGTLWNGAKIIDERLITPDGSMSFQVTINS

The invention claimed is:

1. A system or kit comprising two or more peptide and/or polypeptide components collectively comprising 100% sequence identity to SEQ ID NO: 788 or SEQ ID NO: 789; wherein the two or more peptide and/or polypeptide components are capable of forming a bioluminescent complex upon interacting with each other; wherein a bioluminescent signal produced by the bioluminescent complex in the presence of a coelenterazine or a coelenterazine analog substrate is substantially increased when compared to a bioluminescent signal produced by one of the peptide and/or polypeptide components individually in the presence of the coelenterazine substrate; wherein the system or kit comprises a polypeptide that corresponds structurally to 8 or fewer β strands of a Oplophorus gracilirostris luciferase.

2. The system or kit of claim 1, comprising a polypeptide component having 100% sequence identity to SEQ ID NO: 790 and one or more complementary peptides collectively having 100% sequence identity to SEQ ID NO: 794.

3. The system or kit of claim 1, wherein the polypeptide comprises 100% sequence identity to SEQ ID NO: 791 and the one or more complementary peptides collectively comprise 100% sequence identity to SEQ ID NO: 795.

4. The system or kit of claim 1, wherein the polypeptide comprises 100% sequence identity to SEQ ID NO: 792 and the one or more complementary peptides collectively comprise 100% sequence identity to SEQ ID NO: 796.

5. The system or kit of claim 1, wherein the polypeptide comprises 100% sequence identity to SEQ ID NO: 793 and the one or more complementary peptides collectively comprise 100% sequence identity to SEQ ID NO: 797.

6. The system or kit of claim 1, wherein the polypeptide comprises 100% sequence identity to SEQ ID NO: 790 and the one or more complementary peptides collectively comprise 100% sequence identity to SEQ ID NO: 798.

7. The system or kit of claim 1, wherein the polypeptide comprises 100% sequence identity to SEQ ID NO: 791 and the one or more complementary peptides collectively comprise 100% sequence identity to SEQ ID NO: 799.

8. The system or kit of claim 1, wherein the polypeptide comprises 100% sequence identity to SEQ ID NO: 792 and the one or more complementary peptides collectively comprise 100% sequence identity to SEQ ID NO: 800.

9. The system or kit of claim 1, wherein the polypeptide comprises 100% sequence identity to SEQ ID NO: 793 and the one or more complementary peptides collectively comprise 100% sequence identity to SEQ ID NO: 801.

10. The system or kit of claim 1, wherein one or more of the polypeptide and/or peptide components are present as fusions with one or more additional amino acid sequences.

11. The system or kit of claim 10, wherein the additional amino acid sequence is selected from the group consisting of a protein of interest, an interaction element, a co-localization element, and a binding moiety.

12. The system or kit of claim 10, wherein the additional amino acid sequence is a binding moiety selected from the group consisting of antibody (polyclonal, monoclonal, and/or recombinant), antibody fragment, protein A, an Ig binding domain of protein A, protein G, an Ig binding domain of protein G, protein A/G, an Ig binding domain of protein A/G, protein L, an Ig binding domain of protein L, protein M, an Ig binding domain of protein M, oligonucleotide probe, peptide nucleic acid, DARPin, aptamer, affimer, a purified protein (either the analyte itself or a protein that binds to the analyte), and analyte binding domain(s) of proteins.

13. The system or kit of claim 10, wherein the additional amino acid sequence is a first interaction polypeptide that is configured to form a complex with a second interaction polypeptide upon contact of the first interaction polypeptide and the second interaction polypeptide.

14. The system or kit of claim 10, wherein the additional amino acid sequence is a first co-localization polypeptide that is configured to co-localize within a cellular compartment, a cell, a tissue, or an organism within a with a second co-localization polypeptide.

15. The system or kit of claim 10, wherein the additional amino acid sequence is a protein of interest and is a candidate drug target.

16. A bioluminescent complex comprising the two or more peptide and/or polypeptide components of the system or kit of claim 1.

17. A method comprising contacting the bioluminescent complex of claim 16 with a substrate for the bioluminescent complex.

18. The method of claim 17 wherein the substrate is coelenterazine or furimazine.

* * * * *